US010428317B2

(12) United States Patent
Daly et al.

(10) Patent No.: US 10,428,317 B2
(45) Date of Patent: Oct. 1, 2019

(54) LIGHT-EMITTING MOLECULES

(75) Inventors: John Daly, City Beach (AU); Leon Michael Brownrigg, Mt. Hawthorn (AU); Jim Yu-Hsiang Tiao, Leeming (AU)

(73) Assignee: Gene Stream Pty Ltd, City Beach (AU)

( * ) Notice: Subject to any disclaimer, the term of this patent is extended or adjusted under 35 U.S.C. 154(b) by 0 days.

(21) Appl. No.: 13/990,250

(22) PCT Filed: Dec. 5, 2011

(86) PCT No.: PCT/AU2011/001573

§ 371 (c)(1),
(2), (4) Date: Jun. 28, 2013

(87) PCT Pub. No.: WO2012/071631

PCT Pub. Date: Jun. 7, 2012

(65) Prior Publication Data

US 2013/0273582 A1 Oct. 17, 2013

Related U.S. Application Data

(60) Provisional application No. 61/419,729, filed on Dec. 3, 2010.

(51) Int. Cl.
*C12N 9/02* (2006.01)
*C12Q 1/66* (2006.01)

(52) U.S. Cl.
CPC ............. *C12N 9/0069* (2013.01); *C12Q 1/66* (2013.01); *C12Y 113/12* (2013.01)

(58) Field of Classification Search
None
See application file for complete search history.

(56) References Cited

U.S. PATENT DOCUMENTS

| | | | |
|---|---|---|---|
| 4,873,192 | A | 10/1989 | Kunkel |
| 6,113,886 | A | 9/2000 | Bryan |
| 6,232,107 | B1 | 5/2001 | Bryan |
| 6,436,682 | B1 | 8/2002 | Bryan |
| 7,157,272 | B2 | 1/2007 | Daly |
| 7,297,483 | B2 | 11/2007 | Golz et al. |
| 2002/0150912 | A1 | 10/2002 | Owman et al. |
| 2010/0105090 | A1 | 4/2010 | Golz et al. |

FOREIGN PATENT DOCUMENTS

| | | | | |
|---|---|---|---|---|
| CN | 1476481 | | 2/2004 | |
| CN | 101821384 | | 9/2010 | |
| EP | 1 262 553 | A1 | 12/2002 | |
| EP | 2420573 | A1 * | 2/2012 | ........... C12N 9/0069 |
| JP | 2009-065925 | | 4/2009 | |
| WO | 00/24878 | A2 | 5/2000 | |
| WO | 02/072844 | A1 | 9/2002 | |
| WO | 2008/049160 | | 5/2008 | |
| WO | 2008/049160 | A1 | 5/2008 | |
| WO | 2008/095623 | | 8/2008 | |
| WO | 2009/142735 | | 11/2009 | |
| WO | 2010/119721 | | 10/2010 | |
| WO | WO 2010119721 | A1 * | 10/2010 | |

OTHER PUBLICATIONS

Takenaka et al, Two forms of secreted and thermostable luciferases from the marine copepod crustacean, Metridia pacifica, Gene, 2008, 425, 28-35.*
Machine English-language language translation of WO 2010/119721 published Oct. 2010.*
English-language machine translation of Japanese patent publication 2009-065925 A, 2005.*
Inouye et al., Identification of two catalytic domains in a luciferase secreted by the copepod Gaussia princeps, Biochem. Biophys. Res. Comm., 2008, 365, 96-101.*
Welsh et al., Multiply mutated Gaussia luciferases provide prolonged and intense bioluminescence, \ Biochem. Biophys. Res. Comm., 2009, 389, 563-68.*
Extended European Search Report EP11845321.6-1406, dated Apr. 2, 2014 search, 6 pages.
XP002722646. Accession No. 2009-G56437, WPI Database, Apr. 2, 2009 (3 pages).
(D3) Welsh et al. Multiply mutated *Gaussia* luciferases provide prolonged and intense bioluminescence. Biochemical and Biophysical Research Communications 389 (2009) 563-568.
Notification of the First Office Action, Translation, CN201180061842.2, dated Aug. 4, 2014 (8 pages).
PCT International Search Report, PCT/AU2011/001573 (dated Mar. 22, 2012), 4 pages.
Borisova et al. Recombinant *Metridia* luciferase isoforms: expression, refolding and applicability for in vitro assay. Photochemical and Photobiological Sciences, vol. 7 (2008), pp. 1025-1031.
Inouye and Sahara. Identification of two catalytic domains in a luciferase secreted by the copepod *Gaussia princeps*. Biochemical and Biophysical Research Communications, vol. 365 (2008), pp. 96-101.
Devereux et al. A comprehensive set of sequence analysis programs for the VAX, Nucleic Acids Research, vol. 12, No. 1 (1984), pp. 387-395.
Ausubel et al. Current Protocols in Molecular Biology, John Wiley & Sons Inc., (1994-2010), Chapters 10 (606 pages), 15 (151 pages), 16 (327 pages); Sections 2.10.1 to 2.10.16 (16 pages), 6.3.1-6.3.6 (6 pages), 19.3 (29 pages).

(Continued)

*Primary Examiner* — Robert B Mondesi
*Assistant Examiner* — Todd M Epstein
(74) *Attorney, Agent, or Firm* — Thompson Hine LLP

(57) ABSTRACT

Luciferase polypeptides with improved light-emitting activity and their encoding nucleic acids are disclosed. These molecules are useful in a range of assays including luciferase-based gene reporter assays, bioluminescence resonance energy transfer assays, protein complementation assays and other applications in which luciferase enzymes are utilized as detectable and/or quantifiable labels. Methods and compositions for increasing the sensitivity and/or improving the kinetics of luciferase-catalyzed reactions as well as decreasing the impact of undesirable variables are also disclosed.

11 Claims, 6 Drawing Sheets
(3 of 6 Drawing Sheet(s) Filed in Color)

Specification includes a Sequence Listing.

(56) References Cited

OTHER PUBLICATIONS

Kunkel. Rapid and efficient site-specific mutagenesis without phenotypic selection Proc. Natl. Acad. Sci. USA, vol. 82 (1985), pp. 488-492.
Kunkel et al. Rapid and Efficient Site-Specific Mutagenesis without Phenotypic Selection. Methods in Enzymol, vol. 154 (1987), pp. 367-382. Academic Press.
Arkin and Youvan. An algorithm for protein engineering: Simulations of recursive ensemble mutagenesis Proc. Natl. Acad. Sci. USA, vol. 89 (1992), pp. 7811-7815.
Delagrave et al. Recursive ensemble mutagenesis. Protein Engineering, vol. 6 (1993), pp. 327-331.
Gonnet et al. Exhaustive Matching of the Entire Protein Sequence Database, Science, vol. 256 (1982), pp. 1443-1445.
Needleman and Wunsch. A General Method Applicable to the Search for Similarities in the Amino Acid Sequence of Two Proteins. J. Mol. Biol. vol. 48 (1970), pp. 443-453.
Myers and Miller. Optimal alignments in linear space. Cabios, vol. 4, No. 1 (1989), pp. 11-17.
Altschul et al. Basic Local Alignment Search Tool. J. Mol. Biol., vol. 215 (1990), pp. 403-410.
Altschul et al. Gapped BLAST and PSI-BLAST: a new generation of protein database search programs 1997 Nucleic Acids Res, vol. 25, No. 17 (1997), pp. 3389-3402.
Roberge et al., A strategy for a convergent synthesis of N-linked glycopeptides on a solid support. Science, vol. 269 (1995), pp. 202-204.
Sambrook et al. Molecular Cloning: A Laboratory Manual, 2nd Ed. (Cold Spring Harbor Press, 1989) Sections 16 (83 pages) and 17 (46 pages); 1.101 to 1.104 (6 pages).
Coligan et al. Current Protocols in Protein Science (John Wiley & Sons, Inc. 1995-2010), Chapters 1 (61 pages), 5 (433 pages), and 6 (239 pages).
Dijkema et al. Cloning and expression of the chromosomal immune interferon gene of the rat. EMBO J. vol. 4, No. 3 (1985), pp. 761-767.
Gorman et al. The Rous sarcoma virus long terminal repeat is a strong promoter when introduced into a variety of eukaryotic cells by DNA-mediated transfection. Proc. Natl. Acad. Sci. USA, vol. 79 (1982), pp. 6777-6781.
Boshart et al. A Very Strong Enhancer Is Located Upstream of an Immediate Early Gene of Human Cytomegalovirus. Cell, vol. 41 (1985), pp. 521-530.
Remy and Michnick. A highly sensitive protein-protein interaction assay based on *Gaussia luciferase* Nature Methods, vol. 3, No. 12 (2006), pp. 977-979.
Kim et al. Split Gaussia Luciferase-Based Bioluminescence Template for Tracing Protein Dynamics in Living Cells, Anal Chem. vol. 81 (2009), pp. 67-74.
Roda et al. Biotechnological applications of bioluminescence and chemiluminescence. Trends in Biotechnology, vol. 22, No. 6 (2004), pp. 295-303.
Kricka. Clinical and Biochemical Applications of Luciferases and Luciferins. Anal. Biochem., vol. 175 (1988), pp. 14-21.
International Preliminary Report on Patentability PCT/AU2011/001573, dated Jun. 4, 2013, 6 pages.
Written Opinion of the International Searching Authority PCT/AU2011/001573, dated Mar. 22, 2012, 5 pages.
Inouye and Sahara. Identification of two catalytic domains in a luciferase secreted by the copepod *Gaussia princeps*. Biochem and Biophys Res Comm 365 (2008) 96-101.
Borisova et al. Recombinant *Metridia* luciferase isoforms: expression, refolding and applicability for in vitro assay. Photochem Photobiol Sci, 7 (2008), 1025-1031.
Welsh et al.; "Multiply mutated *Gaussia* luciferases provide prolonged and intense bioluminescence"; Biochemical and Biophysical Research Communications; vol. 389, No. 4 563-568 (Nov. 27, 2009).
Maguire et al.; "*Gaussia* Luciferase Variant for High-Throughput Functional Screening Applications"; Analytical Chemistry, Vo. 81, No. 16, pp. 7102-7106 (Aug. 15, 2009).
English translation of JP 2009-065925 (Apr. 2, 2009).
Notice of Reasons for Rejection issued in Japanese Patent Application No. 2013-541156 (dated Jan. 18, 2016).
Communication issued in European Patent Application No. 11845321.6 (dated Feb. 22, 2016).
Patent Examination Report issued in Australian Patent Application No. 2011335901 (dated May 4, 2016).

* cited by examiner

```
Gaussia (Prolume)       FKDLEPMEQFIAQVDLCVDCTTGCLKGLANVQCSDLLKKWLPQRCATFASKIQGQVDKIKGAGGD---- 185 [SEQ ID NO:2]
Gaussia (ProlumeKDEL)   FKDLEPMEQFIAQVDLCVDCTTGCLKGLANVQCSDLLKKWLPQRCATFASKIQGQVDKIKGAGGDKDEL 189 [SEQ ID NO:4]
Gaussia (Mutant1)       FKDLEPMEQFIAQVDLCVDCTTGCLKGLANVQCSDLLKKWLPQRCATFASKIQGQVDKIKGAGGD---- 185 [SEQ ID NO:5]
Gaussia (Mutant2)       FKDLEPLEQFIAQVDLCVDCTTGCLKGLANVQCSDLLKKWLPQRCATFASKIQGQVDKIKGAGGD---- 185 [SEQ ID NO:8]
Gaussia (GSInGa)        FKDLEPMEQFIAQVDLCVDCTTGCLKGLANVQCSDLLKKWLPQRCATFASKIQGQVDKIKGAGGD---- 171 [SEQ ID NO:10]
MP2a_BAG48250.1         FFDKEPMDQFIAQVDLCVDCTTGCLKGLANVHCSALLKKWLPSRCKTFASKIQSQVDTIKGLAGDR--- 189 [SEQ ID NO:790]
MP2bv1_                 FKDKEPMDQFIAQVDLCVDCTTGCLKGLANVHCSDLLKKWLPSRCKTFASKIQSQVDTIKGLAGDR--- 189 [SEQ ID NO:165]
MP2bv2_DD367132.1       FKDKEPMDQFIAQVDLCVDCTTGCLKGLANVHCSDLLKKWLPSRCKTFASKIQSQVDTIKGLAGDR--- 189 [SEQ ID NO:168]
ML22_DI086277.1         FKEMKPMEQFIAQVDLCEDCTTGCLKGLANVHCSDLLKKWLPSRCKTFASKIQSQVDTIKGLAGDR--- 190 [SEQ ID NO:172]
MP1v1_DD367135.1        FKELGPMEQFIAQVDLCADCTTGCLKGLANVKCSALLKKWLPDRCASFADKIQSEVDNIKGLAGDR--- 210 [SEQ ID NO:792]
MP1v2_DD367131.1        FKELGPMEQFIAQVDLCADCTTGCLKGLANVKCSALLKKWLPDRCASFADKIQSEVDNIKGLAGDR--- 210 [SEQ ID NO:794]
MP1v3_DD367136.1        FKELGPMEQFIAQVDLCADCTTGCLKGLANVKCSALLKKWLPDRCASFADKIQSEVDNIKGLAGDR--- 210 [SEQ ID NO:796]
ML39_EU025117.1         FKEMGPMEQFIAQVDKCTDCTTGCLKGLANVKCSELLKKWLPDRCASFADKIQSEVHNIKGLAGDR--- 209 [SKQ ID NO:172]
ML7_GM711455.1          FKEMEPMEQFIAQVDLCADCTTGCLKGLANVKCSELLKKWLPDRCASFADKIQKEAHNIKGLAGDR--- 169 [SEQ ID NO:798]
MLGS                    FKEMAPMEQFIAQVDKCASCTTGCLKGLANVKCSELLKKWLPDRCASFADKIQKEVHNIKGMAGDR--- 202 [SEQ ID NO:800]
ML164M3_DD453808.1      FKEMAPMEQFIAQVDKCASCTTGCLKGLANVKCSELLKKWLPDRCASFADKIQKEVHNIKGMAGDR--- 182 [SEQ ID NO:802]
ML164v1_DD453808.1      FKEMAPMEQFIAQVDKCASCTTGCLKGLANVKCSELLKKWLPDRCASFADKIQKEVHNIKGMAGDR--- 219 [SEQ ID NO:804]
ML164v2_DI014308.1      FKEMAPMEQFIAQVEKCASCTTGCLKGLANVKCSELLKKWLPDRCASFADKIQKEVHNIKGMAGDR--- 219 [SEQ ID NO:806]
ML16_DI051190.1         FKEMAPMEQFIAQVDKCTSCTTGCLKGLANVKCSELLKKWLPDRCASFADKIQKEVHNIKGMAGDR--- 218 [SEQ ID NO:808]
ML45_AX452581.1         FKEMEPMEQFIAQVDKCASCTTGCLKGLANVKCSELLKKWLPDRCASFADKIQKEVHNIKGMAGDR--- 218 [SEQ ID NO:810]
ML52_AX452582.1         FKEMEPMEQFIAQVDKCASCNTGCLKGLANVKCSELLKKWLPDRCASFADKIQKEVHNIKGMAGDR--- 218 [SEQ ID NO:812]
MLAL_AX453008.1         FKEMAPMEQFIAQVDLCATCTTGCLKGLANVKCSELLKKWLPGRCASFADKIQKEVHNIKGMAGDR--- 218 [SEQ ID NO:814]
                        **:  **:******: *  *.**********:** ******* ** :**.*** :...*** .**
                        |....|....|....|....|....|....|....|....|....|....|....|....|....|...
                        160       170       180       190       200       210       220
                                                6  7   8        9          10
                        FKXXXPXXQFIAQVXXCXXCXTGCLKGLANVXCSXLLKKWLPXBCXXFAXKIQXXXXXIKGXXGDZ
```

Ψ = any amino acid residue, preferably aliphatic amino acid residue, more preferably M or L, even more preferably L B = is selected from basic amino acid residues (*e.g.*, R or K, or modified form thereof)

Z = absent or is a proteinaceous moiety comprising at least one amino acid residues, suitably from about 1 to about 90 amino acid residues, more suitable from about 1 to about 80 amino acid residues, even more suitably from about 1 to about 70 amino acid residues, wherein the proteinaceous moiety optionally comprises a signal peptide for secretion of the polypeptide from a host cell

FIGURE 1 cont'd

LIGHT-EMITTING MOLECULES

RELATED APPLICATIONS

This application is a National Phase of co-pending International Patent Application No. PCT/AU2011/001573 filed Dec. 5, 2011 which claims priority to U.S. Ser. No. 61/419,729 filed Dec. 3, 2010, each of which is expressly incorporated by reference herein in its entirety.

FIELD OF THE INVENTION

This invention relates generally to light-emitting molecules. More particularly, the present invention relates to luciferase polypeptides with improved light-emitting activity and their encoding nucleic acids. These molecules are useful in a range of assays including luciferase-based gene reporter assays, bioluminescence resonance energy transfer assays, protein complementation assays and other applications in which luciferase enzymes are utilized as detectable and/or quantifiable labels. The invention also relates to methods and compositions for increasing the sensitivity and/or improving the kinetics of luciferase-catalyzed reactions as well as decreasing the impact of undesirable variables.

BACKGROUND OF THE INVENTION

Luciferases represent an important tool in biological studies. For example, luciferases are the preferred reporter type for use in gene reporter assays; particularly due to their high sensitivity. Indeed, this high sensitivity has led to their use as labels for antibodies and in other applications where high signal and low background are advantageous. Luciferases are also widely used to study protein:protein interactions via techniques such as protein complementation assays (PCA; as for example disclosed in WO 2008/049160); and particularly for luciferases that emit blue light, in bioluminescence resonance energy transfer (BRET).

Gene reporter assays permit an understanding of what controls the expression of a gene of interest e.g., DNA sequences, transcription factors, RNA sequences, RNA-binding proteins, signal transduction pathways and specific stimuli. In particular, reporter assays can be used to identify nucleic acid regions important in gene regulation. Such regions and/or the factors that bind or modulate them may serve as potential targets for therapeutic intervention in the treatment or prevention of human diseases. Reporter assays can also be used to screen drugs for their ability to modify gene expression.

Reporter assays can be used to identify a gene promoter region or specific elements within a promoter, such as transcription factor binding sites or other regulatory elements. Alternatively, such assays are used to study the response of a promoter or regulatory element to various stimuli or agents. In some applications, the reporter constructs used in the assay, or transfected cells, are introduced into an organism to study promoter function in vivo. Moreover, reporter assays can be used to study or measure signal transduction pathways upstream of a specific promoter. In some cases the promoter comprises a single type of transcription factor (TF) binding site, such that reporter activity reflects the activity of the pathway leading to activation of that TF.

By way of example, in the case of reporter assays designed to investigate putative promoter sequences or other transcriptional regulatory elements, nucleic acids to be interrogated are cloned into reporter plasmids in a location so as to permit the regulation of transcription of a downstream reporter gene, and thus expression of a reporter protein encoded by the reporter gene. The reporter protein should be distinguishable from endogenous proteins present in the cell in which the reporter plasmid is transfected for ease of detection, and preferably expression of the reporter protein should be readily quantifiable. The reporter protein is quantified in an appropriate assay and often expressed relative to the level of a control reporter driven by a ubiquitous promoter such as, for example, the promoter SV40. The control reporter must be distinguishable from the test reporter and is generally contained on a separate vector that is co-transfected with the test vector and used to control for transfection efficiency. Such assays are based on the premise that cells take up proportionally equal amounts of both vectors.

A variety of different applications for gene reporter assays involves measuring a change in gene expression over time or after addition of a compound, such as a drug, ligand, hormone etc. This is of particular importance in drug screening. Following the addition of the drug, detecting a measurable change in levels of the reporter protein may be delayed and diluted as changes in expression levels are transmitted through mRNA to protein. A significant advance in such applications recently made by the present applicant is the combined use of mRNA- and protein-destabilizing elements in the reporter vector to improve the speed and magnitude of response, as described in U.S. Pat. No. 7,157,272, the disclosure of which is incorporated herein by reference in its entirety.

Various reporter gene assay systems are commercially available utilizing different detectable reporter proteins, the most common being chloramphenicol transferase (CAT), β galactosidase (β-gal), secreted alkaline phosphatase, and various fluorescent proteins and luciferases.

Luciferase is the most commonly used reporter protein for in vitro assay systems. Luciferases are enzymes capable of bioluminescence and are found naturally in a range of organisms. In commercially available assay systems, luciferases can be divided into two major groups; those which utilize D-luciferin as a substrate and those which utilize coelenterazine as a substrate. The most widely employed example of the former is firefly luciferase, an intracellular enzyme. Additional examples of luciferases utilizing D-luciferin include other members of *Coleoptera*, such as click beetles and railroad worms. Luciferases may also be distinguished on the basis of whether the organism from which they are derived is terrestrial or aquatic (typically marine). Luciferases utilizing coelenterazine as a substrate are typically derived from marine animals such as the soft coral *Renilla* or copepods such as *Metridia* and *Gaussia*, whereas D-luciferin-utilizing luciferases are typically derived from terrestrial animals. A further means of distinguishing luciferases is on the basis of whether they are secreted or non-secreted in their native state; i.e., in the organism from which they are derived. Luciferases derived from terrestrial organisms are typically non-secreted (intracellular), whilst those derived from marine organisms may be secreted or non-secreted (intracellular). For example, *Renilla* luciferase is intracellular, whereas *Gaussia* luciferase in its native state is a secreted enzyme. The secretion of luciferases by marine organisms is thought to be a protective response designed to distract approaching predators. Other secreted luciferases include those from *Metridia longa, Vargula hilgendorfii, Oplophorus gracilirostris, Pleuromamma xiphias, Cypridina noctiluca* and other members of *Metridinidae*. *Vargula* luciferase utilizes a substrate that is different to coelenterazine or D-luciferin. Another class of luciferase is derived from dinoflagellates.

Luciferase-based assay systems may employ more than one luciferase, typically of different origin and each utilizing a different substrate, enabling both test and control reporter to be measured in the same assay. By way of example, a putative promoter element is cloned upstream of a firefly luciferase reporter gene such that it drives expression of the luciferase gene. This plasmid is transiently transfected into a cell line, along with a control plasmid containing the *Renilla* luciferase gene driven by the SV40 promoter. First luciferin is added to activate the firefly luciferase, activity of this reporter is measured, and then a "quench and activate" reagent is added. This "quench and activate" reagent contains a compound that quenches the luciferin signal and also contains coelenterazine to activate the *Renilla* luciferase, the activity of which is then measured. The level of firefly luciferase activity is dependent not only on promoter activity but also on transfection efficiency. This varies greatly, depending on the amount of DNA, the quality of the DNA preparation and the condition of the cells. The co-transfected control plasmid (*Renilla* luciferase driven by a suitable promoter such as the SV40 promoter) is used to correct for these variables, based on the premise that *Renilla* luciferase activity is proportional to the amount of firefly luciferase-encoding plasmid taken up by the cells. Alternatively or in addition, the *Renilla* luciferase may be used to control for other variables, such as cell number, cell viability and/or general transcriptional activity; or may be used to determine whether a particular treatment or compound applied to the cells affects both promoters or is specific to one of them.

Luciferase-based assay systems, in particular those utilizing one or more intracellular luciferases, often employ two buffers, a lysis buffer and an assay buffer. The lysis buffer is added to the cells first to lyse the cells and thus release luciferase, facilitating subsequent measurement. An assay buffer containing the luciferase substrate and any cofactors is then added, after which measurement of luciferase activity is taken. Measurement may be made immediately (i.e., within seconds) of the addition of the assay buffer (so-called "flash" reaction), or minutes or hours later (so-called "glow" reactions) by using "glow" reagents in the assay buffer that keep the light signal stable for an extended period of time. Flash reactions provide the highest signal strength (light units per second) and thereby have the advantage of providing the highest sensitivity. Glow reactions are particularly advantageous in applications where, for example, the user does not have a suitable luminometer (equipped with injectors) readily available or in some high throughput screening applications where batch-processing requires a delay between injection and measurement.

Secreted luciferases are measured in samples of the conditioned medium surrounding the test cells. As such, lysis buffers are typically not used with secreted luciferases. Secreted luciferases from copepods such as *Metridia* and *Gaussia* species are not only the smallest known luciferases but also provide the highest sensitivity of all known luciferases. Both of these features are clearly advantageous but the latter feature is of particular importance where the reporter gene assayed provides only low levels of luciferase in the cells of interest, for example, where the promoter being studied has only low activity, and/or where the cells of interest are difficult to transfect/transduce with the reporter vector. A further increase in sensitivity would also facilitate the miniaturization of reporter assays by reducing the minimum number of cells required to yield a signal strength that can be reliably measured.

When utilizing assay systems including destabilizing elements such as those described in U.S. Pat. No. 7,157,272, the steady-state luciferase signal is reduced. Thus luciferases that provide higher signal strength would be particularly advantageous for reporter assay systems utilizing destabilizing elements.

As stated above, the luciferases that provide the highest sensitivity are secreted luciferases from the family of luciferases that include copepods such as *Metridia* and *Gaussia* (also referred to herein as "copepod luciferases," "copepod family of luciferases" and the like). However, in some applications it is preferable to use non-secreted luciferases. For example, to enable the use of protein destabilizing elements and thereby improve responsiveness. Consequently, non-secreted versions of copepod luciferases have been developed; for example by removing the functional signal peptide, as disclosed for instance in WO 2008/049160.

A common feature of this family of luciferases is their dependence on folding via the formation of disulfide bridges between their ten conserved cysteines, often designated $C_1$ to $C_{10}$. This feature was recently utilized to develop novel multi-luciferase assays that employ a reducing agent such as DTT to switch off the luciferase or shorten its period of light emission, thereby enabling measurement of a different luciferase in the same sample, as disclosed for example in WO 2008/074100.

In other applications, there is currently a compromise between "flash" and "glow" buffers and luciferases. That is, to obtain an intense flash, the glow phase is sacrificed and vice versa. There is a clear need for systems that can provide a high sensitivity flash reaction but also provide a prolonged glow. Luciferases facilitating the generation of both high flash and prolonged glow from luciferase-catalyzed bioluminescence reactions would provide the user with a dual purpose reagent that can provide high sensitivity (flash reactions) where needed but also provide the convenience of glow reactions for applications where high sensitivity is not required.

To improve the accuracy of luciferase-based assays it is desirable to minimize the effect of unwanted or unavoidable variables on the activity of the luciferase. One such variable is temperature. Most in vitro luciferase-based assays are performed on a laboratory bench at "room temperature". However, it is often impractical or impossible to provide a constant temperature within the samples. For example, the measuring device (e.g. luminometer) typically generates heat, which raises the reaction temperature over time during measurement. This creates inaccuracy because, for example, the reaction temperature is higher in the last sample measured than in the first sample measured; and the measured parameter (luminescence) is affected by temperature as well as by the amount of luciferase present in the sample.

Additionally, the samples and assay reagents are often stored in a fridge or freezer prior to measurement; and variations in the extent of warming prior to initiation of the reaction are not uncommon in practice. Clearly, it is desirable to have a luciferase that displays minimal change in activity in response to fluctuations in temperature above and below room temperature. A particularly desirable feature would be minimal change in activity in response to temperature rises above room temperature, which occur within luminometers.

Additionally, it is desirable to hive a luciferase with an optimal temperature at or about the intended temperature of the measurement assay. For example, this would provide greater sensitivity. As indicated above, room temperature is common for many in vitro luciferase assays. However, 37° C. would be preferable for certain in vivo assays, such as those performed within a living mammal. Other luciferase assays (e.g., as an antibody label) would preferably be performed at or about 4° C. in order to minimize degradation of essential reaction components in the sample and/or assay reagent.

Accordingly, it would be advantageous to be able to customize a luciferase by adjusting its optimal temperature and temperature effect according to the preferred parameters of the intended assay type.

There are a number of disadvantages associated with the known copepod luciferases from *Metridia* and *Gaussia*. In particular, there is a need for luciferases that provide improved sensitivity and accuracy in luciferase reactions. For example, a flash signal strength of greater intensity than is achievable with existing luciferases; and/or a glow signal that is either of greater intensity and/or more stable over time; and/or a temperature effect that is more suitable for the intended assay type.

It would be particularly advantageous to determine the type of structural changes or elements in these luciferases that convey the desirable features. Such knowledge would enable customization and optimization of luciferases, including luciferases within the copepod luciferase family.

SUMMARY OF THE INVENTION

The present invention is based in part on the discovery that modifying certain structural elements of luciferases, including luciferases within the copepod luciferase family can modulate luciferase function. In particular, the present inventors have found that: (1) an L at position 85 or 98 (relative to the consensus numbering shown in FIG. 1); (2) a truncation, in whole or in part, of a region spanning downstream of the signal (secretory) peptide sequence and upstream of about residue 85; (3) at least one 4-residue motif, which includes a conserved cysteine (e.g., $C_5$, $C_6$, $C_9$ and $C_{10}$); (4) at least one 2-residue motif, which includes a conserved cysteine (e.g., $C_5$, $C_6$, $C_9$ and $C_{10}$); and/or (5)); at least one 3-residue motif, which includes a conserved cysteine (e.g., $C_5$, $C_6$, $C_9$ and $C_{10}$) can significantly improve one or more light-emitting characteristics selected from luminescence, flash signal intensity, glow signal intensity, glow signal stability and effective temperature range, including elevating optimal temperature range, of luciferase function. These discoveries have been reduced to practice in novel polypeptides with improved light-emitting kinetics and their use in assays, as described hereafter.

Accordingly, in one aspect, the present invention provides polypeptides, which are suitably in isolated, synthetic, recombinant or purified form, which comprise, consist or consist essentially of an amino acid sequence having luciferase activity, wherein the amino acid sequence is selected from:

(a) an amino acid sequence represented by formula I:

(I)

$LPGKKX_1PX_2X_3VX_4X_5EX_6EANAX_7X_8AGC_1X_9RGC_2LX_{10}C_3LSX_{11}$ $IKC_4TX_{12}X_{13}MX_{14}X_{15}X_{16}IPGB_1C_5X_{17}X_{18}YX_{19}GDKX_{20}X_{21}X_{22}$

-continued $QX_{23}GIX_{24}X_{25}X_{26}X_{27}IVDX_{28}PEIX_{29}GFKX_{30}X_{31}X_{32}PX_{33}X_{34}$ $QFIAQVX_{35}X_{36}C_6X_{37}X_{38}C_7X_{39}TGC_8LKGLANVX_{40}C_9\Sigma X_{41}$ $LLKKWLPX_{42}B_2C_{10}X_{43}X_{44}FAX_{45}KIQX_{46}X_{47}X_{48}X_{49}X_{50}$ $IKGX_{51}X_{52}GD$ wherein:

- $X_1$ is selected from hydrophobic amino acid residues (e.g., aliphatic amino acid residues such as L or M, or modified form thereof);
- $X_2$ is selected from hydrophobic amino acid residues (e.g., aliphatic amino acid residues such as L, or modified form thereof) or basic amino acid residues (e.g., K, or modified form thereof);
- $X_3$ is selected from hydrophobic amino acid residues (e.g., aliphatic amino acid residues such as A, or modified form thereof) or acidic amino acid residues (e.g., E, or modified form thereof);
- $X_4$ is selected from hydrophobic amino acid residues (e.g., aliphatic amino acid residues such as I or L, or modified form thereof) or small amino acid residues (e.g., P, or modified form thereof);
- $X_5$ is selected from hydrophobic amino acid residues (e.g., aliphatic amino acid residues such as I, M or V, or modified form thereof) or basic amino acid residues (e.g., K, or modified form thereof);
- $X_6$ is selected from hydrophobic amino acid residues (e.g., aliphatic amino acid residues such as M, I or L, or modified form thereof);
- $X_7$ is selected from basic amino acid residues (e.g., K or R, or modified form thereof) or hydrophobic amino acid residues (e.g., aromatic amino acid residues such as F, or modified form thereof);
- $X_8$ is selected from basic amino acid residues (e.g., K or R, or modified form thereof);
- $X_9$ is selected from small amino acid residues (e.g., T, or modified form thereof) or basic amino acid residues (e.g., H, or modified form thereof);
- $X_{10}$ is selected from hydrophobic amino acid residues (e.g., aliphatic amino acid residues such as I or V, or modified form thereof);
- $X_{11}$ is selected from basic amino acid residues (e.g., H or K, or modified form thereof);
- $X_{12}$ is selected from small amino acid residues (e.g., P or A, or modified form thereof) or basic amino acid residues (e.g., K, or modified form thereof);
- $X_{13}$ is selected from basic amino acid residues (e.g., K, or modified form thereof) or neutral/polar amino acid residues (e.g., Q, or modified form thereof);
- $X_{14}$ is selected from basic amino acid residues (e.g., K, or modified form thereof) or neutral/polar amino acid residues (e.g., Q, or modified form thereof);
- $X_{15}$ is selected from any amino acid residue (e.g., basic amino acid residues such as K, or modified form thereof, hydrophobic amino acid residues including aliphatic amino acid residues such as V, or modified form thereof, or neutral/polar amino acid residues such as Q, or modified form thereof);
- $X_{16}$ is selected from hydrophobic amino acid residues (e.g., aromatic amino acid residues such as F or Y, or modified form thereof);
- $B_1$ is selected from basic amino acid residues (e.g., R or K, or modified form thereof);

$X_{17}$ is selected from basic amino acid residues (e.g., H, or modified form thereof) or small amino acid residues (e.g., A, or modified form thereof);

$X_{18}$ is selected from acidic amino acid residues (e.g., D, or modified form thereof) or small amino acid residues (e.g., T or S, or modified form thereof);

$X_{19}$ is selected from acidic amino acid residues (e.g., E, or modified form thereof) or small amino acid residues (e.g., G or A, or modified form thereof);

$X_{20}$ is selected from acidic amino acid residues (e.g., D or E, or modified form thereof) or basic amino acid residues (e.g., K, or modified form thereof);

$X_{21}$ is selected from small amino acid residues (e.g., S or T, or modified form thereof);

$X_{22}$ is selected from small amino acid residues (e.g., G or A, or modified form thereof);

$X_{23}$ is selected from small amino acid residues (e.g., G or A, or modified form thereof);

$X_{24}$ is selected from small amino acid residues (e.g., G or A, or modified form thereof) or hydrophobic amino acid residues (e.g., aliphatic amino acid residues such as V, or modified form thereof);

$X_{25}$ is absent or selected from small amino acid residues (e.g., G, or modified form thereof);

$X_{26}$ is selected from acidic amino acid residues (e.g., E, or modified form thereof) or small amino acid residues (e.g., G, or modified form thereof);

$X_{27}$ is selected from small amino acid residues (e.g., A, or modified form thereof) or acidic amino acid residues (e.g., E, or modified form thereof);

$X_{28}$ is selected from hydrophobic amino acid residues (e.g., aliphatic amino acid residues such as I or M, or modified form thereof);

$X_{29}$ is selected from small amino acid residues (e.g., P, S or A, or modified form thereof);

$X_{30}$ is selected from acidic amino acid residues (e.g., D or E, or modified form thereof);

$X_{31}$ is selected from hydrophobic amino acid residues (e.g., aliphatic amino acid residues such as L or M, or modified form thereof) or basic amino acid residues (e.g., K, or modified form thereof);

$X_{32}$ is selected from charged amino acid residues (e.g., acidic amino acid residues such as E, or modified form thereof, or basic amino acid residues such as K, or modified form thereof) or small amino acid residues (e.g., G or A, or modified form thereof);

$X_{33}$ is selected from hydrophobic amino acid residues (e.g., aliphatic amino acid residues such as M or L, or modified form thereof);

$X_{34}$ is selected from acidic amino acid residues (e.g., E or D, or modified form thereof);

$X_{35}$ is selected from acidic amino acid residues (e.g., D or E, or modified form thereof);

$X_{36}$ is selected from hydrophobic amino acid residues (e.g., aliphatic amino acid residues such as L, or modified form thereof) or basic amino acid residues (e.g., R, or modified form thereof);

$X_{37}$ is selected from any amino acid residue (e.g., hydrophobic amino acid residues including aliphatic amino acid residues such as V, or modified form thereof, or small amino acid residues such as A or T, or modified form thereof, or basic amino acid residues such as H or modified form thereof, or acidic amino acid residues such as E or D, or modified form thereof);

$X_{38}$ is selected from acidic amino acid residues (e.g., D, or modified form thereof) or small amino acid residues (e.g., S or T, or modified form thereof);

$X_{39}$ is selected from small amino acid residues (e.g., T, or modified form thereof) or neutral/polar amino acid residues (e.g., N, or modified form thereof);

$X_{40}$ is selected from basic amino acid residues (e.g., K, R or H, or modified form thereof) or neutral/polar amino acid residues (e.g., Q, or modified form thereof);

Σ is selected from small amino acid residues (e.g., S, A or T, or modified form thereof);

$X_{41}$ is selected from acidic amino acid residues (e.g., D or E, or modified form thereof) or small amino acid residues (e.g., A, or modified form thereof);

$X_{42}$ is selected from any amino acid residue (e.g., small amino acid residues such as P, G, T, S or A, or modified form thereof, or neutral/polar amino acid residues such as Q or N, or modified form thereof, basic amino acid residues such as H, K or R or modified form thereof, or acidic amino acid residues such as D or E, or modified form thereof);

$B_2$ is selected from basic amino acid residues (e.g., R or K, or modified form thereof);

$X_{43}$ is selected from small amino acid residues (e.g., A, or modified form thereof) or basic amino acid residues (e.g., K, or modified form thereof);

$X_{44}$ is selected from small amino acid residues (e.g., S or T, or modified form thereof);

$X_{45}$ is selected from acidic amino acid residues (e.g., D, or modified form thereof) or small amino acid residues (e.g., S, or modified form thereof);

$X_{46}$ is selected from small amino acid residues (e.g., G or S, or modified form thereof) or basic amino acid residues (e.g., K, or modified form thereof);

$X_{47}$ is selected from neutral/polar amino acid residues (e.g., Q, or modified form thereof) or acidic amino acid residues (e.g., E, or modified form thereof);

$X_{48}$ is selected from hydrophobic amino acid residues (e.g., aliphatic amino acid residues such as V, or modified form thereof) or small amino acid residues (e.g., A, or modified form thereof);

$X_{49}$ is selected from charged amino acid residues (e.g., acidic amino acid residues such as D, or modified form thereof, or basic amino acid residues such as H, or modified form thereof);

$X_{50}$ is selected from any amino acid residue (e.g., basic amino acid residues such as K, or modified form thereof, or neutral/polar amino acid residues such as N, or modified form thereof, or small amino acid residues such as T, or modified form thereof);

$X_{51}$ is selected from small amino acid residues (e.g., A, or modified form thereof) or hydrophobic amino acid residues (e.g., aliphatic amino acid residues such as L or M, or modified form thereof); and $X_{52}$ is selected from small amino acid residues (e.g., G or A, or modified form thereof), or (b) an amino acid sequence that shares at least 70% (and at least 71% to at least 99% and all integer percentages in between) sequence similarity or sequence identity with the amino acid sequence represented by formula I, wherein the amino acid sequence comprises L, or modified form thereof, at position 1 of formula I.

Suitably, the polypeptides are other than ones comprising or consisting of an amino acid sequence selected from:

```
                                                  [SEQ ID NO: 2]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDLCVDCTTGCLKGLANVQCSDLLKKWLPQRCATFASKIQGQV
DKIKGAGGD
```
(full-length sequence of *Gaussia princeps* Prolume luciferase, also referred to herein as Prolume);

```
                                                  [SEQ ID NO: 4]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDLCVDCTTGCLKGLANVQCSDLLKKWLPQRCATFASKIQGQV
DKIKGAGGDKDEL
```
(full-length sequence of *Gaussia princeps* Prolume KDEL luciferase, also referred to herein as Prolume KDEL);

```
                                                  [SEQ ID NO: 6]
MGVKVLFALICIAVAEAKPTENNEDFNIVAVASNFATTDLDADRGKLPGK
KLPLEVLKEIEANARKAGCTRGCLICLSHIKCTPKMKKFIPGRCHTYEGDKESAQGGIGEAIVD
IPEIPGFKDLEPMEQFIAQVDLCVDCTTGCLKGLANVQCSDLLKKWLPQRCATFASKIQGQVD
KIKGAGGD
```
(full-length sequence of *Gaussia princeps* Mutant 1 luciferase, also referred to herein as Mutant 1);

```
                                                  [SEQ ID NO: 8]
MGVKVLFALICIAVAEAKPTENNEDFNIVAVASNFATTDLDADRGKLPGK
KLPLEVLKELEANARKAGCTRGCLICLSHIKCTPKMKKFIPGRCHTYEGDKESAQGGIGEAIV
DIPEIPGFKDLEPLEQFIAQVDLCVDCTTGCLKGLANVQCSDLLKKWLPQRCATFASKIQGQV
DKIKGAGGD
```
(full-length sequence of *Gaussia princeps* Mutant 2 luciferase, also referred to herein as Mutant 2);

or

```
                                                 [SEQ ID NO: 10]
MEAKPTENNEDFNIVAVASNFATTDLDADRGKLPGKKLPLEVLKEMEANA
RKAGCTRGCLICLSHIKCTPKMKKFIPGRCHTYEGDKESAQGGIGEAIVDIPEIPGFKDLEPME
QFIAQVDLCVDCTTGCLKGLANVQCSDLLKKWLPQRCATFASKIQGQVDKIKGAGGD
```
(full-length sequence of *Gaussia princeps* InGa luciferase, also referred to herein as GSInGa).

In some embodiments, the polypeptide further comprises upstream (e.g., immediately upstream) of the sequence represented by formula I an amino acid sequence represented by formula II:

$$X_{53}X_{54}X_{55}X_{56}X_{57}RGO_1X_{58} \quad \text{(II)}$$

wherein:

$X_{53}$ is absent or is selected from acidic amino acid residues (e.g., D or E, or modified form thereof) or neutral/polar amino acid residues (e.g., N, or modified form thereof), wherein $X_{53}$ is present in some embodiments with the proviso that $X_{54}$ is present;

$X_{54}$ is absent or is selected from any amino acid residue (e.g., hydrophobic amino acid residues including aliphatic amino acid residues such as L or V, or modified form thereof; small amino acid residues such as S, T or A, or modified form thereof; or neutral/polar amino acid residues such as N, or modified form thereof), wherein $X_{54}$ is present in some embodiments with the proviso that $X_{55}$ is present;

$X_{55}$ is absent or is selected from acidic amino acid residues (e.g., D or E, or modified form thereof), wherein $X_{55}$ is present in some embodiments with the proviso that $X_{56}$ is present;

$X_{56}$ is absent or is selected from any amino acid residue (e.g., hydrophobic amino acid residue including aliphatic amino acid residues such as V, or modified form thereof; or small amino acid residues such as S, T or A, or modified form thereof), wherein $X_{56}$ is present in some embodiments with the proviso that $X_{57}$ is present;

$X_{57}$ is selected from acidic amino acid residues (e.g., D or E, or modified form thereof) or neutral/polar amino acid residues (e.g., N, or modified form thereof), wherein $X_{57}$ is present in some embodiments with the proviso that $O_1$ is present;

$O_1$ is absent or is the sequence $J_1J_2J_3$, wherein $J_1$ is selected from small amino acid residues (e.g., G or modified form thereof), $J_2$ is selected from basic amino acid residues (e.g., H or modified form thereof), and $J_3$ is selected from small amino acid residues (e.g., G or modified form thereof), wherein $O_1$ is present in some embodiments with the proviso that $X_{58}$ is present; and $X_{58}$ is selected from basic amino acid residues (e.g., K, or modified form thereof); or small amino acid residues (e.g., G or modified form thereof).

In some embodiments, the polypeptides comprise, consist or consist essentially of an amino acid sequence selected from the group consisting of:

(a) an amino acid sequence selected from:

[SEQ ID NO: 12]
MGVKLIFAVLCVAAAQAATINENFEDIDVVAIGGSFALDVDANRGGHGGL
PGKKMPKEVLVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVHCSALLKKWLPSRCKTFASKI
QSQVDTIKGLAGDR
(full-length *Metridia pacifica* 2a luciferase with H50L
substitution);

[SEQ ID NO: 14]
MGVKLIFAVVCVAAAQAATINENFEDIDLVAIGGSFALDVDANRGGHGGL
PGKKMPKEVLVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVHCSDLLKKWLPSRCKTFASKI
QSQVDTIKGLAGDR
(full-length *Metridia pacifica* 2bv1 luciferase with H50L
substitution);

[SEQ ID NO: 16]
MGVKLIFAVVCVAAAQAATINENFEDIDLVAIGGSFALDVDANRGGHGGL
PGKKMPKEVPVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVHCSDLLKKWLPSRCKTFASKI
QSQVDTIKGLAGDR
(full-length *Metridia pacifica* 2bv2 luciferase with H50L
substitution);

[SEQ ID NO: 18]
MGVKLIFAVVCVAVAQAATIQENFEDIDLVAIGGSFASDVDANRGGHGGL
PGKKMPKEVLMEMEANAKRAGCHRGCLVCLSHIKCTAQMQKFIPGRCHSYAGDKDSAQGGI
AGGAIVDIPEIAGFKEMKPMEQFIAQVDLCEDCTTGCLKGLANVHCSDLLKKWLPSRCKTFAS
KIQSQVDTIKGLAGDR
(full-length *Metridia longa* 22 luciferase with H50L
substitution);

[SEQ ID NO: 20]
MMEIQVLFALICFALVQANPTENKDDIDIVGVEGKFGTTDLETDLFTIVED
MNVISRDTNLANSDADRGKLPGKKLPLEVLIEMEANARKAGCTRGCLICLSKIKCTAKMKVY
IPGRCHDYGGDKKTGQAGIVGAIVDIPEISGFKELGPMEQFIAQVDLCADCTTGCLKGLANVK
CSALLKKWLPDRCASFADKIQSEVDNIKGLAGDR
(full-length *Metridia
pacifica* 1v1 luciferase with M71L substitution);

[SEQ ID NO: 22]
MMEIKVLFALICFALVQANPTENKDDIDIVGVEGKFGTTDLETDLFTIVED
MNVISRDTNLANSDADRGKLPGKKLPLEVLIEMEANARKAGCTRGCLICLSKIKCTAKMKVY
IPGRCHDYGGDKKTGQAGIVGAIVDIPEISGFKELGPMEQFIAQVDLCADCTTGCLKGLANVK
CSALLKKWLPDRCASFADKIQSEVDNIKGLAGDR
(full-length *Metridia
pacifica* 1v2 luciferase with M71L substitution);

[SEQ ID NO: 24]
MMEVKVVFALICFALVQANPTENKDDIDIVGVEGKFGTTDLETDLFTIVED
MNVISRDTNLANSDADRGKL
PGKKLPLEVLIEMEANARKAGCTRGCLICLSKIKCTAKMKVYIPGRCHDYGGDKKTGQAGIV
GAIVDIPEISGFKELGPMEQFIAQVDLCADCTTGCLKGLANVKCSALLKKWLPDRCASFADKI
QSEVDNIKGLAGDR
(full-length *Metridia pacifica* 1v3 luciferase with M71L
substitution);

[SEQ ID NO: 26]
MDIKVLFALICIALVQANPTENNDHINIVGIEGKFGITDLETDLFTIWETNRM
ISTDNEQANTDSNRGKLPGKKLPLAVLIEMEANAFKAGCTRGCLICLSKIKCTAKMKKYIPGR
CHDYGGDKKTGQAGIVGAIVDIPDISGFKEMGPMEQFIAQVDRCTDCTTGCLKGLANVKCSE
LLKKWLPDRCASFADKIQSEVHNIKGLAGDR
(full-length *Metridia longa* 39
luciferase with M70L substitution);

[SEQ ID NO: 28]
MDIKFIFALVCIALVQANPTVNNDVNRGKLPGKKLPLEVLIEMEANAFKAG
CTRGCLICLSKIKCTAKMKQYIPGRCHDYGGDKKTGQAGIVGAIVDIPEISGFKEMEPMEQFIA
QVDLCADCTTGCLKGLANVKCSELLKKWLPDRCASFADKIQKEAHNIKGLAGDR
(full-length *Metridia longa* 7 luciferase with M30L substitution);

[SEQ ID NO: 30]
MKTDIADTDRASNFVATETDANRGKLPGKKLPLAVIMEMEANAFKAGCT
RGCLICLSKIKCTAKMKVYIPGRCHDYGGDKKTGQAGIVGAIVDIPEISGFKEMAPMEQFIAQ
VDRCASCTTGCLKGLANVKCSELLKKWLPDRCASFADKIQKEVHNIKGMAGDR
(full-length *Metridia longa* GS luciferase with M26L substitu-
tion);

-continued

[SEQ ID NO: 32]
MDIKVVFTLVFSALVQAQKTDIADTDRASNFVATETDANRGKLPGKKLPL
AVIMEMEANAFKAGCTRGCLICLSKIKCTAKMKVYIPGRCHDYGGDKKTGQAGIVGAIVDIP
EISGFKEMAPMEQFIAQVDRCASCTTGCLKGLANVKCSELLKKWLPDRCASFADKIQKEVHN
IKGMAGDR
(full-length *Metridia longa* 164M3 luciferase with M43L substitution);

[SEQ ID NO: 34]
MDIKVVFTLVFSALVQAKSTEFDPNIDIVGLEGKFGITNLETDLFTIWETME
VMIKADIADTDRASNFVATETDANRGKLPGKKLPLAVIMEMEANAFKAGCTRGCLICLSKIK
CTAKMKVYIPGRCHDYGGDKKTGQAGIVGAIVDIPEISGFKEMAPMEQFIAQVDRCASCTTG
CLKGLANVKCSELLKKWLPDRCASFADKIQKEVHNIKGMAGDR
(full-length *Metridia longa* 164v1 luciferase with M80L substitution);

[SEQ ID NO: 36]
MDIKVVFTLVFSALVQAKSTEFDPNIDIVGLEGKFGITNLETDLFTIWETME
VMIKADIADTDRASNFVATETDANRGKLPGKKLPLAVIMEMEANAFKAGCTRGCLICLSKIK
CTAKMKVYIPGRCHDYGGDKKTGQAGIVGAIVDIPEISGFKEMAPMEQFIAQVERCASCTTGC
LKGLANVKCSELLKKWLPDRCASFADKIQKEVHNIKGMAGDR
(full-length *Metridia longa* 164v2 luciferase with M80L substitution);

[SEQ ID NO: 38]
MDMKVIFALIFSALVQAKSTEFDPNIDIVGLEGKFGITNLETDLFTIWETME
VIKSDIADTDRVSNFVATETDANRGKLPGKKLPLAVIMEMEANAFKAGCTRGCLICLSKIKCT
AKMKVYIPGRCHDYGGDKKTGQAGIVGAIVDIPEISGFKEMAPMEQFIAQVDRCTSCTTGCL
KGLANVKCSELLKKWLPDRCASFADKIQKEVHNIKGMAGDR
(full-length *Metridia longa* 16 luciferase with M79L substitution);

[SEQ ID NO: 40]
MDIKVVFALVFSALVQAKSTEFDPNIDIVGLEGKFGITNLETDLFTIWETME
VIKTDIADTDRARSFVATETDANRGKLPGKKLPLAVIMEMEANAFKAGCTRGCLICLSKIKCT
AKMKVYIPGRCHDYGGDKKTGQAGIVGAIVDIPEISGFKEMEPMEQFIAQVDRCASCTTGCL
KGLANVKCSELLKKWLPDRCASFADKIQKEVHNIKGMAGDR
(full-length *Metridia longa* 45 luciferase with M79L substitution);

[SEQ ID NO: 42]
MDIKVVFALVFSALVQAKSTEFDPNIDVVGLEGKFGITNLETDLFTIWETM
EVIKTDIADTDRARNFVATETDANRGKLPGKKLPLAVIMEMEANAFKAGCTRGCLICLSKIKC
TAKMKVYIPGRCHDYGGDKKTGQAGIVGAIVDIPEISGFKEMEPMEQFIAQVDRCASCNTGC
LKGLANVKCSELLKKWLPDRCASFADKIQKEVHNIKGMAGDR
(full-length *Metridia longa* 52 luciferase with M79L substitution);
and

[SEQ ID NO: 44]
MDMRVIFALVFSSLVQAKSTEFDPNINIVGLEGKFGITNLETDLFTIWETMD
VIKSDITDTDRVSNFVATETDANRGKLPGKKLPLAVIMEMEANAFKAGCTRGCLICLSKIKCT
AKMKVYIPGRCHDYGGDKKTGQAGIVGAIVDIPEISGFKEMAPMEQFIAQVDLCATCTTGCL
KGLANVKCSELLKKWLPGRCASFADKIQKEVHNIKGMAGDR
(full-length *Metridia longa* AL luciferase with M79L substitution);
or (b) an amino acid sequence that shares at least 70% (and at least 71% to at least 99% and all integer percentages in between) sequence similarity or sequence identity with the sequence set forth in any one of SEQ ID NO: 12, 14, 16, 18, 20, 22, 24, 26, 28, 30, 32, 34, 36, 38, 40, 42 or 44, wherein the amino acid sequence comprises L, or modified form thereof, at a position corresponding to position 1 of formula I; or (c) an amino acid sequence which is encoded by the nucleotide sequence set forth in any one of:

[SEQ ID NO: 11]
atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggnytnccnggnaaraaratg
ccnaargargtnytngtngaratggargcnaaygcnaarmgngcnggntgycaymgnggntgyytnathtgyytnwsncayathaartgya
cnaaraaratgaaraarttyathccnggnmgntgycaywsntaygarggngayaargaywsngcncarggnggnathggngargarathgt
ngayatgccngarathccnggnttyaargayaargarccnatggaycarttyathgcncargtngayytntgygtngaytgyacnacnggntgy
ytnaarggnytngcnaaygtncaytgywsngcnytnytnaaraartggytnccnwsnmgntgyaaracnttygcnwsnaarathcarwsnc
argtngayacnathaarggnytngcnggngaymgn
(nucleotide sequence encoding full-length
*Metridia pacifica* 2a luciferase with H50L substitution);

-continued

[SEQ ID NO: 13]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggnytnccnggnaararaaratg
ccnaargargtnytngtngaratggargcnaaygcnaarmgngcnggntgycaymgnggntgyytnathtgyytnwsncayathaartgya
cnaaraaratgaaraarttyathccnggnmgntgycaywsntaygarggngayaargaywsngcncarggnggnathggngargarathgt
ngayatgccngarathccnggnttyaargayaargarccnatggaycarttyathgcncargtngayytntgygtngaytgyacnacnggntgy
ytnaarggnytngcnaaygtncaytgywsngayytnytnaaraartggytnccnwsnmgntgyaaracnttygcnwsnaarathcarwsnc
argtngayacnathaarggnytngcnggngaymgn
(nucleotide sequence encoding full-length
*Metridia pacifica* 2bv1 luciferase with H50L substitution);

[SEQ ID NO: 15]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggnytnccnggnaararaaratg
ccnaargargtnytngtngaratggargcnaaygcnaarmgngcnggntgycaymgnggntgyytnathtgyytnwsncayathaartgya
cnaaraaratgaaraarttyathccnggnmgntgycaywsntaygarggngayaargaywsngcncarggnggnathggngargarathgt
ngayatgccngarathccnggnttyaargayaargarccnatggaycarttyathgcncargtngayytntgygtngaytgyacnacnggntgy
ytnaarggnytngcnaaygtncaytgywsngayytnytnaaraartggytnccnwsnmgntgyaaracnttygcnwsnaarathcarwsnc
argtngayacnathaarggnytngcnggngaymgn
(nucleotide sequence encoding full-length
*Metridia pacifica* 2bv2 luciferase with H50L substitution);

[SEQ ID NO: 17]
atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggnytnccnggnaararaaratg
ccnaargargtnytnatggaratggargcnaaygcnaarmgngcnggntgycaymgnggntgyytngtntgyytnwsncayathaartgya
cngcncaratgcaraarttyathccnggnmgntgycaywsntaygcnggngayaargaywsngcncarggnggnathgcnggnggngcn
athgtngayathccngarathgcnggnttyaargaratgaarccnatggarcarttyathgcncargtngayytntgygargaytgyacnacngg
ntgyytnaarggnytngcnaaygtncaytgywsngayytnytnaaraartggytnccnwsnmgntgyaaracnttygcnwsnaarathcar
wsncargtngayacnathaarggnytngcnggngaymgn
(nucleotide sequence encoding full-
length *Metridia longa* 22 luciferase with H50L substitution);

[SEQ ID NO: 19]
atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaarytnccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding full-length *Metridia pacifica* 1v1 with M71L
substitution);

[SEQ ID NO: 21]
atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaarytnccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding full-length *Metridia pacifica* 1v2 luciferase
with M71L substitution);

[SEQ ID NO: 23]
atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaarytnccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding full-length *Metridia pacifica* 1v3 luciferase
with M71L substitution);

[SEQ ID NO: 25]
atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaarytnccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ycaygaytayggnggngayaaraaracnggncargcnggnathgtnggngcnathgtngayathccngayathwsnggnttyaargaratg
ggnccnatggarcarttyathgcncargtngaymgntgyacngaytgyacnacnggntgyytnaarggnytngcnaaygtnaartgywsng
arytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
M70L substitution);

-continued

[SEQ ID NO: 27]

atggayathaarttyathttygcnytngtntgyathgcnytngtncargcnaayccnacngtnaayaaygaygtnaa
ymgnggnaarytnccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgycaygaytayggnggngayaaraaracngg
ncargcnggnathgtnggngcnathgtngayathccngarathwsnggnttyaargaratggarccnatggarcarttyathgcncargtngay
ytntgygcngaytgyacnacnggntgyytnaarggnytngcnaaygtnaartgywsngarytnytnaaraartggytnccngaymgntgyg
cnwsnttygcngayaarathcaraargargcncayaayathaarggnytngcnggngaymgn
(nucleotide
sequence encoding full-length *Metridia longa* 7 luciferase with M30L substitution];

[SEQ ID NO: 29]

atgaaracngayathgcngayacngaymgngcnwsnaayttygtngcnacngaracngaygcnaaymgngg
naarytnccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgycaygaytayggnggngayaaraaracnggncargcn
ggnathgtnggngcnathgtngayathccngarathwsnggnttyaargaratggcnccnatggarcarttyathgcncargtngaymgntgy
gcnwsntgyacnacnggntgyytnaarggnytngcnaaygtnaartgywsngarytnytnaaraartggytnccngaymgntgygcnwsn
ttygcngayaarathcaraargargtncayaayathaarggnatggcnggngaymgn
(nucleotide
sequence encoding full-length *Metridia longa* GS luciferase with M30L substitution);

[SEQ ID NO: 31]

atggayathaargtngtnttyacnytngtnttywsngcnytngtncargcncaraaracngayathgcngayacng
aymgngcnwsnaayttygtngcnacngaracngaygcnaaymgnggnaarytnccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgycaygaytayggnggngayaaraaracnggncargcnggnathgtnggngcnathgtngayathccngarathwsnggn
ttyaargaratggcnccnatggarcarttyathgcncargtngaymgntgygcnwsntgyacnacnggntgyytnaarggnytngcnaaygt
naartgywsngarytnytnaaraartggytnccngaymgntgygcnwsnttygcngayaarathcaraargargtncayaayathaarggnat
ggcnggngaymgn
(nucleotide sequence encoding full-length *Metridia longa* 164M3
luciferase with M43L substitution);

[SEQ ID NO: 33]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaarytnccnggnaaraarytnccny
tngcngtnathatggaratggargcnaaygcnttyaargcnggntgyacnmgnggntgyytnathtgyytnwsnaarathaartgyacngcn
aaratgaargtntayathccnggnmgntgycaygaytayggnggngayaaraaracnggncargcnggnathgtnggngcnathgtngaya
thccngarathwsnggnttyaargaratggcnccnatggarcarttyathgcncargtngaymgntgygcnwsntgyacnacnggntgyytn
aarggnytngcnaaygtnaartgywsngarytnytnaaraartggytnccngaymgntgygcnwsnttygcngayaarathcaraargargt
ncayaayathaarggnatggcnggngaymgn
(nucleotide sequence encoding full-length
*Metridia longa* 164v1 luciferase with M70L substitution);

[SEQ ID NO: 35]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaryncc
ngg naaraarytnccny
tngcngtnathatggaratggargcnaaygcnttyaargcnggntgyacnmgnggntgyytnathtgyytnwsnaarathaartgyacngcn
aaratgaargtntayathccnggnmgntgycaygaytayggnggngayaaraaracnggncargcnggnathgtnggngcnathgtngaya
thccngarathwsnggnttyaargaratggcnccnatggarcarttyathgcncargtngarmgntgygcnwsntgyacnacnggntgyytn
aarggnytngcnaaygtnaartgywsngarytnytnaaraartggytnccngaymgntgygcnwsnttygcngayaarathcaraargargt
ncayaayathaarggnatggcnggngaymgn
(nucleotide sequence encoding full-length
*Metridia longa* 164v2 luciferase with M80L substitution);

[SEQ ID NO: 37]

atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaarytnccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgycaygaytayggnggngayaaraaracnggncargcnggnathgtnggngcnathgtngayathc
cngarathwsnggnttyaargaratggcnccnatggarcarttyathgcncargtngaymgntgyacnwsntgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length *Metridia*
*longa* 16 with M79L substitution);

[SEQ ID NO: 39]

atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaarytnccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcnwsntgyacnacnggntgyytnaa
rggnytngcnaaygtnaartgywsngarytnytnaaraartggytnccngaymgntgygcnwsnttygcngayaarathcaraargargtnc
ayaayathaarggnatggcnggngaymgn
(nucleotide sequence encoding full-length
*Metridia longa* 45 luciferase with M79L substitution);

-continued

[SEQ ID NO: 41]
atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaarytnccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcnwsntgyaayacnggntgyytnaa
rggnytngcnaaygtnaartgywsngarytnytnaaraartggytnccngaymgntgygcnwsnttygcngayaarathcaraargargtnc
ayaayathaarggnatggcnggngaymgn
(nucleotide sequence encoding full-length
*Metridia longa* 52 luciferase with M79L substitution);
or

[SEQ ID NO: 43]
atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaayttygtngcnacngaracngaygcnaaymgnggnaarytnccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggcnccnatggarcarttyathgcncargtngayytntgygcnacntgyacnacnggntgyytnaarg
gnytngcnaaygtnaartgywsngarytnytnaaraartggytnccnggnmgntgygcnwsnttygcngayaarathcaraargargtncay
aayathaarggnatggcnggngaymgn
(nucleotide sequence encoding full-length *Metridia longa* AL luciferase with M79L substitution);

or a complement of any one of 11, 13, 15, 17, 19, 21, 23, 25, 27, 29, 31, 33, 35, 37, 39, 41 or 43;

(d) an amino acid sequence which is encoded by a nucleotide sequence that shares at least 70% (and at least 71% to at least 99% and all integer percentages in between) sequence identity with the sequence set forth in any one of SEQ ID NO: 11, 13, 15, 17, 19, 21, 23, 25, 27, 29, 31, 33, 35, 37, 39, 41 or 43, or a complement thereof, wherein the amino acid sequence comprises L, or modified form thereof, at a position corresponding to position 1 of formula I; or (e) an amino acid sequence which is encoded by a nucleotide sequence that hybridizes under at least medium or high stringency conditions to the sequence set forth in any one of SEQ ID NO: 11, 13, 15, 17, 19, 21, 23, 25, 27, 29, 31, 33, 35, 37, 39, 41 or 43, or a complement thereof, wherein the amino acid sequence comprises L, or modified form thereof, at a position corresponding to position 1 of formula I.

In some embodiments, the polypeptides lack a functional secretion-enhancing sequence. In illustrative examples of this type, the polypeptides comprise, consist or consist essentially of an amino acid sequence selected from:

(a) an amino acid sequence selected from:

SEQ ID NO: 46
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDLCVDCTTGCLKGLANVQ
CSDLLKKWLPQRCATFASKIQGQVDKIKGAGGD,
[intracellular *Gaussia princeps* Prolume luciferase];

SEQ ID NO: 48
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDLCVDCTTGCLKGLANVQ
CSDLLKKWLPQRCATFASKIQGQVDKIKGAGGDKDEL,
[intracellular *Gaussia princeps* Prolume KDEL luciferase];

SEQ ID NO: 50
DLDADRGKLPGKKLPLEVLKEIEANARKAGCTRGCLICLSHIKCTPKMKKF
IPGRCHTYEGDKESAQGGIGEAIVDIPEIPGFKDLEPMEQFIAQVDLCVDCTTGCLKGLANVQC
SDLLKKWLPQRCATFASKIQGQVDKIKGAGGD,
[intracellular *Gaussia princeps* Mutant 1 luciferase];

SEQ ID NO: 52
DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDLCVDCTTGCLKGLANVQ
CSDLLKKWLPQRCATFASKIQGQVDKIKGAGGD,
[intracellular *Gaussia princeps* Mutant 2 luciferase];

SEQ ID NO: 54
DVDANRGGHGGLPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSALLKKWLPSRCKTFASKIQSQVDTIKGLAGDR,
[intracellular
*Metridia pacifica* 2a luciferase with H50L substitution];

SEQ ID NO: 56
DVDANRGGHGGLPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSDLLKKWLPSRCKTFASKIQSQVDTIKGLAGDR,
[intracellular
*Metridia pacifica* 2bv1 luciferase with H50L substitution];

-continued

SEQ ID NO: 58
DVDANRGGHGGLPGKKMPKEVPVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSDLLKKWLPSRCKTFASKIQSQVDTIKGLAGDR,
[intracellular
*Metridia pacifica* 2bv2 luciferase with H50L substitution];

SEQ ID NO: 60
DVDANRGGHGGLPGKKMPKEVLMEMEANAKRAGCHRGCLVCLSHIKCT
AQMQKFIPGRCHSYAGDKDSAQGGIAGGAIVDIPEIAGFKEMKPMEQFIAQVDLCEDCTTGCL
KGLANVHCSDLLKKWLPSRCKTFASKIQSQVDTIKGLAGDR,
[intracellular
*Metridia longa* 22 luciferase with H50L substitution];
and SEQ ID NO: 62
NSDADRGKLPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSALLKKWLPDRCASFADKIQSEVDNIKGLAGDR,
[intracellular *Metridia*
*pacifica* v1&2&3 luciferases with M71L substitution];

SEQ ID NO: 64
NTDSNRGKLPGKKLPLAVLIEMEANAFKAGCTRGCLICLSKIKCTAKMKK
YIPGRCHDYGGDKKTGQAGIVGAIVDIPDISGFKEMGPMEQFIAQVDRCTDCTTGCLKGLAN
VKCSELLKKWLPDRCASFADKIQSEVHNIKGLAGDR,
[intracellular *Metridia*
*longa* 39 luciferase with M70L substitution];

SEQ ID NO: 66
NNDVNRGKLPGKKLPLEVLIEMEANAFKAGCTRGCLICLSKIKCTAKMKQ
YIPGRCHDYGGDKKTGQAGIVGAIVDIPEISGFKEMEPMEQFIAQVDLCADCTTGCLKGLANV
KCSELLKKWLPDRCASFADKIQKEAHNIKGLAGDR,
[intracellular *Metridia*
*longa* 7 luciferase with M30L substitution];

[SEQ ID NO: 68]
ETDANRGKLPGKKLPLAVIMEMEANAFKAGCTRGCLICLSKIKCTAKMKV
YIPGRCHDYGGDKKTGQAGIVGAIVDIPEISGFKEMAPMEQFIAQVDRCASCTTGCLKGLANV
KCSELLKKWLPDRCASFADKIQKEVHNIKGMAGDR
(intracellular *Metridia*
*longa* GS luciferase with M26L substitution);

SEQ ID NO: 70
ETDANRGKLPGKKLPLAVIMEMEANAFKAGCTRGCLICLSKIKCTAKMKV
YIPGRCHDYGGDKKTGQAGIVGAIVDIPEISGFKEMAPMEQFIAQVDRCASCTTGCLKGLANV
KCSELLKKWLPDRCASFADKIQKEVHNIKGMAGDR,
[intracellular *Metridia*
*longa* 164M3&v1 luciferases with M43L substitution relative to the
numbering of full-length *Metridia longa* 164M3];

SEQ ID NO: 72
ETDANRGKLPGKKLPLAVIMEMEANAFKAGCTRGCLICLSKIKCTAKMKV
YIPGRCHDYGGDKKTGQAGIVGAIVDIPEISGFKEMAPMEQFIAQVERCASCTTGCLKGLANV
KCSELLKKWLPDRCASFADKIQKEVHNIKGMAGDR,
[intracellular *Metridia*
*longa* 164v2 luciferase with M80L substitution];

SEQ ID NO: 74
ETDANRGKLPGKKLPLAVIMEMEANAFKAGCTRGCLICLSKIKCTAKMKV
YIPGRCHDYGGDKKTGQAGIVGAIVDIPEISGFKEMAPMEQFIAQVDRCTSCTTGCLKGLANV
KCSELLKKWLPDRCASFADKIQKEVHNIKGMAGDR,
[intracellular *Metridia*
*longa* 16 luciferase with M79L substitution];

SEQ ID NO: 76
ETDANRGKLPGKKLPLAVIMEMEANAFKAGCTRGCLICLSKIKCTAKMKV
YIPGRCHDYGGDKKTGQAGIVGAIVDIPEISGFKEMEPMEQFIAQVDRCASCTTGCLKGLANV
KCSELLKKWLPDRCASFADKIQKEVHNIKGMAGDR,
[intracellular *Metridia*
*longa* 45 luciferase with M79L substitution];

SEQ ID NO: 78
ETDANRGKLPGKKLPLAVIMEMEANAFKAGCTRGCLICLSKIKCTAKMKV
YIPGRCHDYGGDKKTGQAGIVGAIVDIPEISGFKEMEPMEQFIAQVDRCASCNTGCLKGLANV
KCSELLKKWLPDRCASFADKIQKEVHNIKGMAGDR,
[intracellular *Metridia*
*longa* 52 luciferase with M79L substitution];

-continued

SEQ ID NO: 80

ETDANRGKLPGKKLPLAVIMEMEANAFKAGCTRGCLICLSKIKCTAKMKV
YIPGRCHDYGGDKKTGQAGIVGAIVDIPEISGFKEMAPMEQFIAQVDLCATCTTGCLKGLANV
KCSELLKKWLPGRCASFADKIQKEVHNIKGMAGDR,
[intracellular *Metridia*
*longa* AL luciferase with M79L substitution];

SEQ ID NO: 82

EAEAERGKLPGKKLPLEVLIEMEANARKAGCTRGCLICLSKIKCTAKMKK
YIPGRCADYGGDKKTGQAGIVGAIVDIPEISGFKEMEPMEQFIAQVDRCADCTTGCLKGLANV
KCSDLLKKWLPGRCATFADKIQSEVDNIKGLAGDR,
[intracellular *Metridia longa* GS2 luciferase];

(b) an amino acid sequence that shares at least 70% (and at least 71% to at least 99% and all integer percentages in between) sequence similarity or sequence identity with the sequence set forth in any one of SEQ ID NO: 46, 48, 50. 52, 54, 56, 58, 60, 62, 64, 66, 68, 70, 72, 74, 76, 78, 80 or 82, wherein the amino acid sequence comprises L, or modified form thereof, at a position corresponding to position 1 of formula I; or (c) an amino acid sequence which is encoded by the nucleotide sequence set forth in any one of:

[SEQ ID NO: 45]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay (nucleotide sequence encoding intracellular *Gaussia princeps* Prolume luciferase);

[SEQ ID NO: 47]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ayaargaygarytn (nucleotide sequence encoding intracellular *Gaussia princeps* Prolume
KDEL luciferase);

[SEQ ID NO: 49]

gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay (nucleotide sequence encoding intracellular *Gaussia princeps* Mutant 1 luciferase);

[SEQ ID NO: 51]

gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnytngarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay (nucleotide sequence encoding intracellular *Gaussia princeps* Mutant 2 luciferase);

[SEQ ID NO: 53]

gaygtngaygcnaaymgnggnggncayggnggnytnccnggnaaraaratgccnaargargtnytngtngara
tggargcnaaygcnaarmgngcnggntgycaymgnggntgyytnathtgyytnwsncayathaartgyacnaaraaratgaaraarttyath
ccnggnmgntgycaywsntaygarggngayaargaywsngcncarggnggnathggngargarathgtngayatgccngarathccngg
nttyaargayaargarccnatggaycarttyathgcncargtngayytntgygtngaytgyacnacnggntgyytnaarggnytngcnaaygtn
caytgywsngcnytnytnaaraartggytnccnwsnmgntgyaaracnttygcnwsnaarathcarwsncargtngayacnathaarggny
tngcnggngaymgn (nucleotide sequence encoding intracellular *Metridia pacifica* 2a
luciferase with H50L substitution);

[SEQ ID NO: 55]

gaygtngaygcnaaymgnggnggncayggnggnytnccnggnaaraaratgccnaargargtnytngtngara
tggargcnaaygcnaarmgngcnggntgycaymgnggntgyytnathtgyytnwsncayathaartgyacnaaraaratgaaraarttyath
ccnggnmgntgycaywsntaygarggngayaargaywsngcncarggnggnathggngargarathgtngayatgccngarathccngg
nttyaargayaargarccnatggaycarttyathgcncargtngayytntgygtngaytgyacnacnggntgyytnaarggnytngcnaaygtn
caytgywsngayytnytnaaraartggytnccnwsnmgntgyaaracnttygcnwsnaarathcarwsncargtngayacnathaarggny
tngcnggngaymgn (nucleotide sequence encoding intracellular *Metridia pacifica* 2bv1
luciferase with H50L substitution);

-continued

[SEQ ID NO: 57]
gaygtngaygcnaaymgnggnggncayggnggnytnccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngayytnytnaaraartggytnccnwsnmgntgyaaracnttygcnwsnaarathcarwsncargtngayacnathaarggn
ytngcnggngaymgn (nucleotide sequence encoding intracellular *Metridia pacifica*
2bv2 luciferase with H50L substitution);

[SEQ ID NO: 59]
gaygtngaygcnaaymgnggnggncayggnggnytnccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgycaywsntaygcnggngayaargaywsngcncarggnggnathgcnggnggngcnathgtngayathccngarath
gcnggnttyaargaratgaarccnatggarcarttyathgcncargtngayytntgygargaytgyacnacnggntgyytnaarggnytngcna
aygtncaytgywsngayytnytnaaraartggytnccnwsnmgntgyaaracnttygcnwsnaarathcarwsncargtngayacnathaa
rggnytngcnggngaymgn (nucleotide sequence encoding intracellular *Metridia longa*
22 luciferase with H50L substitution);

[SEQ ID NO: 61]
aaywsngaygcngaymgnggnaarytnccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn (nucleotide sequence encoding intracellular *Metridia pacifica* v1&2&3
luciferase with M71L substitution);

[SEQ ID NO: 63]
aayacngaywsnaaymgnggnaarytnccnggnaaraarytnccnytngcngtnytnathgaratggargcna
aygcnttyaargcnggntgyacnmgnggntgyytnathtgyytnwsnaarathaartgyacngcnaaratgaaraarayathccnggnmg
ntgycaygaytayggnggngayaaraaracnggncargcnggnathgtnggngcnathgtngayathccngayathwsnggnttyaargar
atgggnccnatggarcarttyathgcncargtngaymgntgyacngaytgyacnacnggntgyytnaarggnytngcnaaygtnaartgyws
ngarytnytnaaraartggytnccngaymgntgygcnwsnttygcngayaarathcarwsngargtncayaayathaarggnytngcnggn
gaymgn (nucleotide sequence encoding intracellular *Metridia longa* 39 luciferase
with M70L substitution);

[SEQ ID NO: 65]
aayaaygaygtnaaymgnggnaarytnccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gycaygaytayggnggngayaaraaracnggncargcnggnathgtnggngcnathgtngayathccngarathwsnggnttyaargarat
ggarccnatggarcarttyathgcncargtngayytntgygcngaytgyacnacnggntgyytnaarggnytngcnaaygtnaartgywsng
arytnytnaaraartggytnccngaymgntgygcnwsnttygcngayaarathcaraargargcncayaayathaarggnytngcnggngay
mgn (nucleotide sequence encoding intracellular *Metridia longa* 7 luciferase with
M30L substitution);

[SEQ ID NO: 67]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* GS luciferase with
M26L substitution);

[SEQ ID NO: 69]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular Metridia longa 164M3&v1 luciferase with
M43L substitution relative to the numbering of full-length *Metridia longa* 164M3);

[SEQ ID NO: 71]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 164v2 luciferase
with M80L substitution);

-continued

[SEQ ID NO: 73]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 16 luciferase with
M79L substitution);

[SEQ ID NO: 75]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 45 luciferase with
M79L substitution];

[SEQ ID NO: 77]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcnwsntgyaayacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 52 luciferase with
M79L substitution);

[SEQ ID NO: 79]
garacngaygcnaaymgnggnaarytnccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngayytntgygcnacntgyacnacnggntgyytnaarggnytngcnaaygtnaartgywsng
arytnytnaaraartggytnccnggnmgntgygcnwsnttygcngayaarathcaraargargtncayaayathaarggnatggcnggngay
mgn (nucleotide sequence encoding intracellular *Metridia longa* AL luciferase with
M79L substitution); or

[SEQ ID NO: 81]
gargcngargcngarmgnggnaarytnccnggnaaraarytnccnytngargtnytnathgaratggargcnaay
gcnmgnaargcnggntgyacnmgnggntgyytnathtgyytnwsnaarathaartgyacngcnaaratgaaraartayathccnggnmgn
tgygcngaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccnaaymgntgygcnwsnttygcngayaarathcarwsngargtngayaayathaarggnytngcnggng
aymgn (nucleotide sequence encoding intracellular *Metridia longa* GS2 luciferase);

or a complement of any one of 45, 47, 49, 51, 53, 55, 57, 59, 61, 63, 65, 67, 69, 71, 73, 75, 77, 79 or 81, wherein the amino acid sequence comprises L, or modified form thereof, at a position corresponding to position 1 of formula I;

(d) an amino acid sequence which is encoded by a nucleotide sequence that shares at least 70% (and at least 71% to at least 99% and all integer percentages in between) sequence identity with the sequence set forth in any one of SEQ ID NO: 45, 47, 49, 51, 53, 55, 57, 59, 61, 63, 65, 67, 69, 71, 73, 75, 77, 79 or 81, or a complement thereof, wherein the amino acid sequence comprises L, or modified form thereof, at a position corresponding to position 1 of formula I; or (e) an amino acid sequence which is encoded by a nucleotide sequence that hybridizes under at least medium or high stringency conditions to the sequence set forth in any one of SEQ ID NO: 45, 47, 49, 51, 53, 55, 57, 59, 61, 63, 65, 67, 69, 71, 73, 75, 77, 79 or 81, or a complement thereof, wherein the amino acid sequence comprises L, or modified form thereof, at a position corresponding to position 1 of formula I.

In some embodiments, the polypeptides comprise, consist or consist essentially of an amino acid sequence represented by formula III:

$$Z_1\text{-}\Pi\text{-}Z_2 \qquad \text{(III)}$$

wherein:

Π is selected from the amino acid sequence represented by formula I or an amino acid sequence that shares at least 70% (and at least 71% to at least 99% and all integer percentages in between) sequence similarity or sequence identity with the amino acid sequence represented by formula I, wherein the amino acid sequence comprises L, or modified form thereof, at a position corresponding to position 1 of formula I;

$Z_1$ is absent or is selected from at least one of a proteinaceous moiety comprising from about 1 to about 80 amino acid residues (and all integer residues therebetween), an amino acid residue for initiation of protein synthesis in vivo (e.g., M or modified form thereof), and a protecting moiety (e.g., an N-terminal blocking residue such as pyroglutamate); and $Z_2$ is absent or is a proteinaceous moiety comprising from about 1 to about 50 amino acid residues (and all integer residues therebetween).

Suitably, $Z_1$ comprises, consists or consists essentially of a signal peptide for secreting the polypeptide to an extracellular location. In some embodiments, the signal peptide comprises an amino acid sequence represented by formula IV:

$$U_1X_{60}X_{61}X_{62}X_{63}X_{64}X_{65}FX_{66}X_{67}X_{68}X_{69}X_{70}X_{71}X_{72}X_{73}X_{74}A \qquad \text{(IV)}$$

wherein:

$U_1$ is absent or is selected from at least one of an amino acid residue for initiation of protein synthesis in vivo (e.g., M, or modified form thereof) and an N-terminal blocking residue;

$X_{60}$ is absent or is an amino acid residue for initiation of protein synthesis in vivo (e.g., M or modified form thereof);

$X_{61}$ is selected from small amino acid residues (e.g., G, or modified forms thereof) or acidic amino acid residues (e.g., E or D, or modified forms thereof);

$X_{62}$ is selected from hydrophobic amino acid residues (e.g., aliphatic amino acid residues such as V, I or M, or modified form thereof);

$X_{63}$ is selected from basic amino acid residues (e.g., K, or modified form thereof) or neutral/polar amino acid residues (e.g., Q, or modified form thereof);

$X_{64}$ is selected from hydrophobic amino acid residues including aliphatic amino acid residues (e.g., V or L, or modified form thereof) and aromatic amino acid residues (e.g., F, or modified form thereof);

$X_{65}$ is selected from hydrophobic amino acid residues (e.g., aliphatic amino acid residues such as L, V or I, or modified form thereof);

$X_{66}$ is selected from small amino acid residues (e.g., A or T, or modified forms thereof);

$X_{67}$ is selected from hydrophobic amino acid residues (e.g., aliphatic amino acid residues such as L or V, or modified form thereof);

$X_{68}$ is selected from hydrophobic amino acid residues (e.g., aliphatic amino acid residues such as I, V or L, or modified form thereof);

$X_{69}$ is selected from hydrophobic amino acid residues including aliphatic amino acid residues (e.g., C, or modified form thereof) and aromatic amino acid residues (e.g., F, or modified form thereof);

$X_{70}$ is selected from hydrophobic amino acid residues including aliphatic amino acid residues (e.g., I or V, or modified form thereof) and aromatic amino acid residues (e.g., F, or modified form thereof) or small amino acid residues (e.g., S, or modified forms thereof);

$X_{71}$ is selected from small amino acid residues (e.g., A or S, or modified forms thereof);

$X_{72}$ is selected from hydrophobic amino acid residues (e.g., aliphatic amino acid residues such as V or L, or modified form thereof) or small amino acid residues (e.g., A, or modified forms thereof);

$X_{73}$ is selected from small amino acid residues (e.g., A, or modified forms thereof) or hydrophobic amino acid residues (e.g., aliphatic amino acid residues such as V, or modified form thereof); and $X_{74}$ is selected from acidic amino acid residues (e.g., E, or modified forms thereof) or neutral/polar amino acid residues (e.g., Q, or modified form thereof).

Representative signal peptides comprise, consist or consist essentially of an amino acid sequence selected from the group consisting of:

(a)

MGVKVLFALICIAVAEA
[SEQ ID NO: 84, signal peptide of *Gaussia princeps* Prolume, Prolume KDEL, Mutant 1 and Mutant 2], MGVKLIFAVLCVAAAQA
[SEQ ID NO: 86, signal peptide of *Metridia pacifica* 2a, 2bv1, 2bv2 and Metridia longa 22 luciferases], MMEIQVLFALICFALVQA
[SEQ ID NO: 88, signal peptide of *Metridia pacifica* 1v1 luciferase], MMELKVLFALICFALVQA
[SEQ ID NO: 90, signal peptide of *Metridia pacifica* 1v2 luciferase], MMEVKVVFALICFALVQA
[SEQ ID NO: 92, signal peptide of *Metridia pacifica* 1v3 luciferase], MDIKVLFALICIALVQA
[SEQ ID NO: 94, signal peptide of *Metridia longa* 39 luciferase], MDIKFIFALVCIALVQA
[SEQ ID NO: 96, signal peptide of *Metridia longa* 7 luciferase], MDIKVVFTLVFSALVQA
[SEQ ID NO: 98, signal peptide of *Metridia longa* 164M3, v1 and v2 luciferases], MDMKVIFALIFSALVQA
[SEQ ID NO: 100, signal peptide of *Metridia longa* 16 luciferase], MDIKVVFALVFSALVQA
[SEQ ID NO: 102, signal peptide of *Metridia longa* 45 and 52 luciferases] or MDMRVIFALVFSSLVQA
[SEQ ID NO: 104, signal peptide of *Metridia longa* AL luciferases];

(b) an amino acid sequence that shares at least 70% (and at least 71% to at least 99% and all integer percentages in between) sequence similarity or sequence identity with the sequence set forth in any one of SEQ ID NO: 84, 86, 88, 90, 92, 94, 96, 98, 100, 102 or 104;

(c) an amino acid sequence which is encoded by the nucleotide sequence set forth in any one of:

[SEQ ID NO: 83]
atgggngtnaargtnytnttygcnytnathtgyathgcngtngcngargcn
(nucleotide sequence encoding signal peptide of *Gaussia princeps* Prolume, Prolume KDEL, Mutant 1 or Mutant 2 luciferases);

[SEQ ID NO: 85]
atgggngtnaarytnathttygcngtnytntgygtngcngcngcncargcn
(nucleotide sequence encoding signal peptide of *Metridia pacifica* 2a, 2bv1, 2bv2 or *Metridia longa* 22 luciferases);

[SEQ ID NO: 87]
atgatggarathcargtnytnttygcnytnathtgyttygcnytngtncargcn
(nucleotide sequence encoding signal peptide of *Metridia pacifica* 1v1 luciferase);

[SEQ ID NO: 89]
atgatggarathaargtnytnttygcnytnathtgyttygcnytngtncargcn
(nucleotide sequence encoding signal peptide of *Metridia pacifica* 1v2 luciferase);

[SEQ ID NO: 91]
atgatggargtnaargtngtnttygcnytnathtgyttygcnytngtncargcn
(nucleotide sequence encoding signal peptide of *Metridia pacifica* 1v3 luciferase);

[SEQ ID NO: 93]
atggayathaargtnytnttygcnytnathtgyathgcnytngtncargcn
(nucleotide sequence encoding signal peptide of *Metridia longa* 39 luciferase);

[SEQ ID NO: 95]
atggayathaarttyathttygcnytngtntgyathgcnytngtncargcn
(nucleotide
sequence encoding signal peptide of *Metridia longa* 7 luciferase);

[SEQ ID NO: 97]
atggayathaargtngtnttyacnytngtnttywsngcnytngtncargcn
(nucleotide sequence encoding signal peptide of *Metridia longa* 164M3, v1 or v2 luciferases);

[SEQ ID NO: 99]
atggayatgaargtnathttygcnytnathttywsngcnytngtncargcn
(nucleotide sequence encoding signal peptide of *Metridia longa* 16 luciferase);

[SEQ ID NO: 101]
atggayathaargtngtnttygcnytngtnttywsngcnytngtncargcn
(nucleotide sequence encoding signal peptide of *Metridia longa* 45 and 52 luciferases), or

[SEQ ID NO: 103]
atggayatgmgngtnathttygcnytngtnttywsnwsnytngtncargcn
(nucleotide sequence encoding signal peptide of *Metridia longa* AL luciferase);

or a complement of any one of SEQ ID NO: 83, 85, 87, 89, 91, 93, 95, 97, 99, 101 or 103;

(d) an amino acid sequence which is encoded by a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof; or (e) an amino acid sequence which is encoded by a nucleotide sequence that hybridizes under at least medium or high stringency conditions to the sequence set forth in any one of SEQ ID NO: 83, 85, 87, 89, 91, 93, 95, 97, 99, 101 or 103, or a complement thereof.

In some embodiments, $Z_1$ comprises, consists or consists essentially of a secretion-enhancing sequence. Non-limiting examples of secretion-enhancing sequences are selected from the group consisting of:

(a) an amino acid sequence selected from:

KPTENNEDFNIVAVASNFATT
[SEQ ID NO: 106, secretion-enhancing sequence of *Gaussia princeps* Prolume, Prolume KDEL, Mutant 1 and Mutant 2 luciferases], ATINENFEDIDVVAIGGSFAL
[SEQ ID NO: 108, secretion-enhancing sequence of *Metridia pacifica* 2a luciferase], ATINENFEDIDLVAIGGSFAL
[SEQ ID NO: 110, secretion-enhancing sequence of *Metridia pacifica* 2bv1&2 luciferases], -continued ATIQENFEDIDLVAIGGSFAS
[SEQ ID NO: 112, secretion-enhancing sequence of *Metridia longa* 22 luciferase], NPTENKDDIDIVGVEGKFGTTDLETDLFTIVEDMNVISRDTNLA
[SEQ ID NO: 114, secretion-enhancing sequence of *Metridia pacifica* v1&2&3 luciferases], NPTENNDHINIVGIEGKFGITDLETDLFTIWETNRMISTDNEQA
[SEQ ID NO: 116, secretion-enhancing sequence of *Metridia longa* 39];

NPTV
[SEQ ID NO: 118, secretion-enhancing sequence of *Metridia longa* 7 luciferase];

KTDIADTDRASNFVAT
[SEQ ID NO: 120, secretion-enhancing sequence of *Metridia longa* GS luciferase];

QKTDIADTDRASNFVAT
[SEQ ID NO: 122, secretion-enhancing sequence of *Metridia longa* 164M3 luciferase];

KSTEFDPNIDIVGLEGKFGITNLETDLFTIWETMEVMIKADIADTDRASNEVAT
[SEQ ID NO: 124, secretion-enhancing sequence of *Metridia longa* 164v1&2 luciferases];

KSTEFDPNIDIVGLEGKFGITNLETDLFTIWETMEVIKSDIADTDRVSNFVAT
[SEQ ID NO: 126, secretion-enhancing sequence of *Metridia longa* 16 luciferase];

KSTEFDPNIDIVGLEGKFGITNLETDLFTIWETMEVIKTDIADTDRARSFVAT
[SEQ ID NO: 128, secretion-enhancing sequence of *Metridia longa* 45 luciferase];

KSTEFDPNIDVVGLEGKFGITNLETDLFTIWETMEVIKTDIADTDRARNFVAT
[SEQ ID NO: 130, secretion-enhancing sequence of *Metridia longa* 52 luciferase];

KSTEFDPNINIVGLEGKFGITNLETDLFTIWETMDVIKSDITDTDRVSNFVAT
[SEQ ID NO: 132, secretion-enhancing sequence of *Metridia longa* AL luciferase]; or;

(b) an amino acid sequence that shares at least 70% (and at least 71% to at least 99% and all integer percentages in between) sequence similarity or sequence identity with the sequence set forth in any one of SEQ ID NO: 106, 107, 108, 110, 112, 114, 116, 118, 120, 122, 124, 126, 128, 130 or 132; or (c) an amino acid sequence which is encoded by the nucleotide sequence set forth in any one of:

[SEQ ID NO: 105]
aarccnacngaraayaaygargayttyaayathgtngcngtngcnwsnaayttygcnacnacn
(nucleotide sequence encoding secretion-enhancing sequence of *Gaussia princeps* Prolume, Prolume KDEL, Mutant 1 and Mutant 2 luciferases);

[SEQ ID NO: 107]
gcnacnathaaygaraayttygargayathgaygtngtngcnathggnggnwsnttygcnytn
(nucleotide sequence encoding secretion-enhancing sequence of *Metridia pacifica* 2a luciferase);

[SEQ ID NO: 109]
gcnacnathaaygaraayttygargayathgayytngtngcnathggnggnwsnttygcnytn
(nucleotide sequence encoding secretion-enhancing sequence of *Metridia pacifica* 2bv1&2 luciferases);

[SEQ ID NO: 111]
gcnacnathcargaraayttygargayathgayytngtngcnathggnggnwsnttygcnwsn
(nucleotide sequence encoding secretion-enhancing sequence of *Metridia longa* 22 luciferase);

[SEQ ID NO: 113]
aayccnacngaraayaargaygayathgayathgtnggngtngarggnaarttyggnacnacngayytngarac
ngayytnttyacnathgtngargayatgaaygtnathwsnmgngayacnaayytngcn
(nucleotide sequence encoding secretion-enhancing sequence of *Metridia pacifica* v1&2&3 luciferases);

[SEQ ID NO: 115]
aayccnacngaraayaaygaycayathaayathgtnggnathgarggnaarttyggnathacngayytngaracn
gayytnttyacnathtgggaracnaaymgnatgathwsnacngayaaygarcargcn
(nucleotide
sequence encoding secretion-enhancing sequence of *Metridia longa* 39 luciferase);

```
                                                               [SEQ ID NO: 117]
aayccnacngtn
(nucleotide sequence encoding secretion-enhancing sequence of Metridia longa GS);

                                                               [SEQ ID NO: 119]
aaracngayathgcngayacngaymgngcnwsnaayttygtngcnacn
(nucleotide sequence encoding secretion-enhancing sequence of Metridia longa 7 luciferase);

                                                               [SEQ ID NO: 121]
caraaracngayathgcngayacngaymgngcnwsnaayttygtngcnacn
(nucleotide sequence encoding secretion-enhancing sequence of Metridia longa 164M3 luciferase);

                                                               [SEQ ID NO: 123]
aarwsnacngarttygayccnaayathgayathgtnggnytngarggnaarttyggnathacnaayytngaracn
gayytnttyacnathtgggaracnatggargtnatgathaargcngayathgcngayacngaymgngcnwsnaayttygtngcnacn
(nucleotide sequence encoding secretion-enhancing sequence of Metridia longa
164v1&2 luciferases);

                                                               [SEQ ID NO: 125]
aarwsnacngarttygayccnaayathgayathgtnggnytngarggnaarttyggnathacnaayytngaracn
gayytnttyacnathtgggaracnatggargtnathaarwsngayathgcngayacngaymgngtnwsnaayttygtngcnacn
(nucleotide sequence encoding secretion-enhancing sequence of Metridia longa 16
luciferase);

                                                               [SEQ ID NO: 127]
aarwsnacngarttygayccnaayathgayathgtnggnytngarggnaarttyggnathacnaayytngaracn
gayytnttyacnathtgggaracnatggargtnathaaracngayathgcngayacngaymgngcnmgnwsnttygtngcnacn
(nucleotide sequence encoding secretion-enhancing sequence of Metridia longa 45
luciferase);

                                                               [SEQ ID NO: 129]
aarwsnacngarttygayccnaayathgaygtngtnggnytngarggnaarttyggnathacnaayytngaracn
gayytnttyacnathtgggaracnatggargtnathaaracngayathgcngayacngaymgngcnmgnaayttygtngcnacn
(nucleotide sequence encoding secretion-enhancing sequence of Metridia longa 52
luciferase);

                                                               [SEQ ID NO: 131]
aarwsnacngarttygayccnaayathaayathgtnggnytngarggnaarttyggnathacnaayytngaracn
gayytnttyacnathtgggaracnatggaygtnathaarwsngayathacngayacngaymgngtnwsnaayttygtngcnacn
(nucleotide sequence encoding secretion-enhancing sequence of Metridia longa AL
luciferase),
```

or a complement of any one of 105, 107, 109, 111, 113, 115, 117, 119, 121, 123, 125, 127, 129 or 131;

(d) an amino acid sequence which is encoded by a nucleotide sequence that shares at least 70% (and at least 71% to at least 99% and all integer percentages in between) sequence identity with the sequence set forth in any one of SEQ ID NO: 105, 107, 109, 111, 113, 115, 117, 119, 121, 123, 125, 127, 129 or 131, or a complement thereof; or (e) an amino acid sequence which is encoded by a nucleotide sequence that hybridizes under at least medium or high stringency conditions to the sequence set forth in any one of SEQ ID NO: 105, 107, 109, 111, 113, 115, 117, 119, 121, 123, 125, 127, 129 or 131, or a complement thereof.

In some embodiments, $X_{17}$ is other than H.

In some embodiments, $X_{17}$ is selected from small amino acid residues (e.g., A, S or T, or modified form thereof) or acidic amino acid residues (e.g., E or modified form thereof).

In specific embodiments, $X_{17}$ is A or modified form thereof.

In some embodiments, the subsequence $B_1C_5X_{17}X_{18}$ consists of an amino acid sequence represented by formula V:

$$BC\Omega\Omega \qquad (V)$$

wherein:
B is selected from basic amino acid residues (e.g., R or K, or modified form thereof); and
$\Omega$ is selected from small amino acid residues (e.g., A, S or T, or modified form thereof) or acidic amino acid residues (e.g., D or E, or modified form thereof)

In specific embodiments, $X_{17}$ is A or modified form thereof.

In some embodiments, $X_{18}$ is selected from small amino acid residues (e.g., T or S, or modified form thereof).

In some embodiments, the subsequence $B_1C_5X_{17}X_{18}$ is selected from RCAD, KCAD, RCED, KCED, RCSD, KCSD, RCTD, KCTD, RCAT and RCAS.

In some embodiments, $X_{36}$ is selected from basic amino acid residues (e.g., R or K, or modified form thereof) or neutral polar amino acid residues (e.g., Q or modified form thereof).

In some embodiments, $X_{37}$ is selected from A or E, or modified form.

In some embodiments, $X_{38}$ is D or modified form thereof.

In some embodiments, the subsequence $X_{36}C_6X_{37}X_{38}$ is selected from RCAD, KCAD, RCED, KCED, RCSD, KCSD, RCTD and KCTD, suitably from RCAD and RCED.

In some embodiments, $X_{40}$ is selected from basic amino acid residues (e.g., K or R, or modified form thereof).

In some embodiments, $\Sigma$ is selected from S or T, or modified form thereof.

In some embodiments, $X_{41}$ is selected from D, or modified form thereof.

In some embodiments, the subsequence $X_{40}C_9\Sigma X_{41}$ is KCSD.

In some embodiments, at least one subsequence of the polypeptides selected from $B_1C_5X_{17}X_{18}$, $X_{36}C_6X_{37}X_{38}$ and $X_{40}C_9\Sigma X_{41}$ consists of an amino acid sequence represented by formula VI:

$$BC\Omega D \qquad (VI)$$

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

In illustrative examples of this type, the subsequence $B_1C_5X_{17}X_{18}$ is selected from RCAD, KCAD, RCED, KCED, RCSD, KCSD, RCTD and KCTD.

In illustrative examples, the subsequence $X_{36}C_6X_{37}X_{38}$ is selected from RCAD, KCAD, RCED, KCED, RCSD, KCSD, RCTD and KCTD.

In illustrative examples, the subsequence $X_{40}C_9\Sigma X_{41}$ consists of the sequence KCSD.

In some embodiments, $X_{42}$ is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof.

In some embodiments, at least 1, 2, 3 or all 4 subsequence(s) selected from $B_1C_5X_{17}X_{18}$, $X_{36}C_6X_{37}X_{38}$, $X_{40}C_9\Sigma X_{41}$ and $B_2C_{10}X_{43}X_{44}$ consist(s) of an amino acid sequence represented by formula V (i.e., BCΩΩ) as defined above. In illustrative examples of this type, the amino acid sequence represented by formula V is selected from BCAD (e.g., RCAD, KCAD), BCAT (e.g., RCAT, KCAT), BCED (e.g., RCED, KCED), BCSD (e.g., RCSD, KCSD), BCTD (e.g., RCTD, KCTD), and BCAS (e.g., RCAS, KCAS).

In some embodiments, one or both of $X_{36}C_6$ and $X_{40}C_9$ consists of an amino acid sequence represented by formula XIII:

BC (XIII)

wherein:

B is selected from basic amino acid residues (e.g., R or K, or modified form thereof).

In some illustrative examples of these embodiments, at least 1, 2, 3 or all subsequence(s) selected from $B_1C_5$, $X_{36}C_6$, $X_{40}C_9$ and $B_2C_{10}$ are present within a subsequence consisting of the amino acid sequence represented by formula XIV:

BCΩ (XIV)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

In these examples, BCΩ suitably consists of a sequence selected from BCA or BCE.

In some embodiments, at least 1, 2, 3 or all subsequence(s) selected from $B_1C_5X_{17}$, $X_{36}C_6X_{37}$, $X_{40}C_9\Sigma$ and $B_2C_{10}X_{43}$ consist of an amino acid sequence represented by formula XV:

BCA (XV)

wherein:

B is selected from basic amino acid residues (e.g., R or K, or modified form thereof).

In some illustrative examples of these embodiments, the amino acid sequence BCA is present within a subsequence selected from BCAD or BCAT. In these examples, the subsequence $B_1C_5X_{17}X_{18}$ is suitably represented by BCAD or BCAT. Suitably, the subsequence $B_2C_{10}X_{43}$ is represented by BCAT.

In some illustrative examples of these embodiments, the amino acid sequence BCA is present within the subsequence GBCAT. In these examples, the subsequence GBCAT suitably represents one or both of the subsequences $GB_1C_5X_{17}X_{18}$ and $X_{42}B_2C_{10}X_{43}$.

In some embodiments, $X_{42}$ is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof. In some illustrative examples of these embodiments, the subsequence $B_2C_{10}X_{43}$ is represented by BCA or the subsequence $B_2C_{10}X_{43}X_{44}$ is represented by BCAT.

In some embodiments, one or both of $X_{35}X_{36}C_6$ and $X_{42}B_2C_{10}$ consists of an amino acid sequence represented by formula XVI:

EBC (XVI)

wherein:

B is selected from basic amino acid residues (e.g., R or K, or modified form thereof).

In some embodiments, $X_{42}B_2C_{10}$ consists of an amino acid sequence represented by formula XVII:

GBC (XVII)

wherein:

B is selected from basic amino acid residues (e.g., R or K, or modified form thereof).

In some illustrative examples of these embodiments, one or both of $GB_1C$ and $X_{42}B_2C_{10}$ are present within a subsequence represented by formula XVIII:

GBCΩ (XVIII)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

Suitably, GBCΩ is GBCA.

In some illustrative examples of these embodiments, one or both of $GB_1C$ and $X_{42}B_2C_{10}$ are present within a subsequence represented by formula XIX:

GBCΩΩ (XIX)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

Suitably, GBCΩΩ is GBCAT.

In the some embodiments, the polypeptides may optionally comprise any one or more of a signal sequence for secreting the polypeptide to an extracellular location and a secretion-enhancing sequence.

In some embodiments, polypeptides comprising an amino acid sequence according to formula I as broadly described above have any one or more activities selected from the group consisting of enhanced luminescence, stronger flash signal intensity, enhanced glow signal intensity, enhanced stability of glow signal and enhanced effective temperature range, including elevated optimal temperature range, for operation of the enzyme to a reference luciferase polypeptide without L at position 85 (relative to the consensus numbering shown in FIG. 1) (e.g., relative to any one or more of the following luciferases: *Metridia pacifica* 2a, *Metridia pacifica* 2bv1&2, *Metridia longa* 22, *Metridia pacifica* v1&2&, *Metridia longa* 39, *Metridia longa* GS *Metridia longa* 7, *Metridia longa* 164M3, *Metridia longa* 164v1&2, *Metridia longa* 16, *Metridia longa* 45, *Metridia longa* 52 and *Metridia longa* AL).

In another aspect, the present invention provides isolated, synthetic, recombinant or purified nucleic acid molecules that comprise, consist or consist essentially of a nucleotide sequence encoding the amino acid sequence of a polypeptide according to formula I as broadly described above, including a polypeptide according to formula I as further defined by any one or more of the embodiments relating to formula I. In some embodiments, the nucleic acid molecules comprise, consist or consist essentially of a nucleotide sequence selected from the group consisting of:

(a) a nucleotide sequence that encodes an amino acid sequence selected from any one of SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80 or 82;

(b) a nucleotide sequence selected from any one of SEQ ID NO:11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79 or 81, or a complement thereof;

(c) a nucleotide sequence that shares at least 70% (and at least 71% to at least 99% and all integer percentages in between) sequence identity with the sequence set forth in any one of SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79 or 81, or a complement thereof, wherein the amino acid sequence encoded by the nucleotide sequence comprises L, or modified form thereof, at a position corresponding to position 1 of formula I; or (d) a nucleotide sequence that hybridizes under at least low, medium or high stringency conditions to the sequence set forth in any one of SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79 or 81, or a complement thereof, wherein the amino acid sequence encoded by the nucleotide sequence comprises L, or modified form thereof, at a position corresponding to position 1 of formula I.

In some embodiments, the nucleic acid molecules further comprise a nucleotide sequence encoding a signal peptide, representative examples of which are selected from:

(a) a nucleotide sequence as set forth in any one of 83, 85, 87, 89, 91, 93, 95, 97, 99, 101 or 103, or a complement thereof;

(b) a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof; or (c) a nucleotide sequence that hybridizes under at least low, medium or high stringency conditions to the sequence set forth in any one of SEQ ID NO: 83, 85, 87, 89, 91, 93, 95, 97, 99, 101 or 103, or a complement thereof.

In some embodiments, the nucleic acid molecules further comprise a nucleotide sequence encoding a secretion-enhancing sequence, representative examples of which are selected from:

(a) a nucleotide sequence as set forth in any one of SEQ ID NO:105, 107, 109, 111, 113, 115, 117, 119, 121, 123, 125, 127, 129 or 131, or a complement thereof;

(b) a nucleotide sequence that shares at least 70% (and at least 71% to at least 99% and all integer percentages in between) sequence identity with the sequence set forth in any one of SEQ ID NO: 105, 107, 109, 111, 113, 115, 117, 119, 121, 123, 125, 127, 129 or 131, or a complement thereof; or (c) a nucleotide sequence that hybridizes under at least low, medium or high stringency conditions to the sequence set forth in any one of SEQ ID NO: 105, 107, 109, 111, 113, 115, 117, 119, 121, 123, 125, 127, 129 or 131, or a complement thereof.

In some embodiments, the polypeptide encoded by the nucleic acid molecule as broadly described above has any one or more activities selected from the group consisting of enhanced luminescence, stronger flash signal intensity, enhanced glow signal intensity, enhanced stability of glow signal and enhanced effective temperature range, including elevated optimal temperature range, for operation of the enzyme relative to a reference luciferase polypeptide without L at position 85 (relative to the consensus numbering shown in FIG. 1) (e.g., relative to any one or more of the following luciferases: *Metridia pacifica* 2a, *Metridia pacifica* 2bv1&2, *Metridia longa* 22, *Metridia pacifica* v1&2&, *Metridia longa* 39, *Metridia longa* GS *Metridia longa* 7, *Metridia longa* 164M3, *Metridia longa* 164v1&2, *Metridia longa* 16, *Metridia longa* 45, *Metridia longa* 52 and *Metridia longa* AL).

The present inventors have also found that the secretion-enhancing domain of luciferases, as defined for example above, is not essential for luciferase activity and its functional deletion in some embodiments improves one or more luciferase activities. Thus, in another aspect, the present invention provides polypeptides, which are suitably in isolated, synthetic, recombinant or purified form, which comprise, consist or consist essentially of an amino acid sequence having luciferase activity, wherein the amino acid sequence is represented by formula VII:

$$\Psi\text{-}\Theta \qquad \text{(VII)}$$

wherein:

Ψ comprises at least one of an amino acid residue for initiation of protein synthesis in vivo (e.g., M or modified form thereof), a protecting moiety (e.g., an N-terminal blocking residue such as pyroglutamate) and optionally a signal sequence for secretion of the polypeptide to an extracellular location; and Θ comprises, consists or consists essentially of:

(a) an amino acid sequence having luciferase activity, wherein the amino acid sequence is represented by formula VIII:

(VIII)

$\Delta X_1PGKKX_2PX_3X_4VX_5X_6EX_7EANAX_8X_9AGC_1X_{10}RGC_2LX_{11}C_3LS$ $X_{12}IKC_4TX_{13}X_{14}MX_{15}X_{16}X_{17}IPGB_1C_5X_{18}X_{19}YX_{20}GDKX_{21}X_{22}$ $X_{23}QX_{24}GIX_{25}X_{26}X_{27}X_{28}IVDX_{29}PEIX_{30}GFKX_{31}X_{32}X_{33}PX_{34}$ $X_{35}QFIAQVX_{36}X_{37}C_6X_{38}X_{39}C_7X_{40}TGC_8LKGLANVX_{41}C_9\Sigma X_{42}$ $LLKKWLPX_{43}B_2C_{10}X_{44}X_{45}FAX_{46}KIQX_{47}X_{48}X_{49}X_{50}X_{51}IKG$ $X_{52}X_{53}GD$ wherein:

Δ is absent or is a proteinaceous moiety comprising from about 1 to about 20 amino acid residues (and all integer residues in between), which is not a functional secretion-enhancing sequence;

$X_1$ is selected from hydrophobic amino acid residues (e.g., aliphatic amino acid residues such as L or M, or modified form thereof) or basic amino acid residues (e.g., H, or modified form thereof);

$X_2$ is selected from hydrophobic amino acid residues (e.g., aliphatic amino acid residues such as L or M, or modified form thereof);

$X_3$ is selected from hydrophobic amino acid residues (e.g., aliphatic amino acid residues such as L, or modified form thereof) or basic amino acid residues (e.g., K, or modified form thereof);

$X_4$ selected from hydrophobic amino acid residues (e.g., aliphatic amino acid residues such as A, or modified form thereof) or acidic amino acid residues (e.g., E, or modified form thereof);

$X_5$ is selected from hydrophobic amino acid residues (e.g., aliphatic amino acid residues such as I or L, or modified form thereof) or small amino acid residues (e.g., P, or modified form thereof);

$X_6$ is selected from hydrophobic amino acid residues (e.g., aliphatic amino acid residues such as I, M or V, or modified form thereof) or basic amino acid residues (e.g., K, or modified form thereof);

$X_7$ is selected from hydrophobic amino acid residues (e.g., aliphatic amino acid residues such as M, I or L, or modified form thereof);

$X_8$ is selected from basic amino acid residues (e.g., K or R, or modified form thereof) or hydrophobic amino acid residues (e.g., aromatic amino acid residues such as F, or modified form thereof);

$X_9$ is selected from basic amino acid residues (e.g., K or R, or modified form thereof);

$X_{10}$ is selected from small amino acid residues (e.g., T, or modified form thereof) or basic amino acid residues (e.g., H, or modified form thereof);

$X_{11}$ is selected from hydrophobic amino acid residues (e.g., aliphatic amino acid residues such as I or V, or modified form thereof);

$X_{12}$ is selected from basic amino acid residues (e.g., H or K, or modified form thereof);

$X_{13}$ is selected from small amino acid residues (e.g., P or A, or modified form thereof) or basic amino acid residues (e.g., K, or modified form thereof);

$X_{14}$ is selected from basic amino acid residues (e.g., K, or modified form thereof) or neutral/polar amino acid residues (e.g., Q, or modified form thereof);

$X_{15}$ is selected from basic amino acid residues (e.g., K, or modified form thereof) or neutral/polar amino acid residues (e.g., Q, or modified form thereof);

$X_{16}$ is selected from any amino acid residue (e.g., basic amino acid residues such as K, or modified form thereof, hydrophobic amino acid residues including aliphatic amino acid residues such as V, or modified form thereof, or neutral/polar amino acid residues such as Q, or modified form thereof);

$X_{17}$ is selected from hydrophobic amino acid residues (e.g., aromatic amino acid residues such as F or Y, or modified form thereof);

$B_1$ is selected from basic amino acid residues (e.g., R or K, or modified form thereof);

$X_{18}$ is selected from basic amino acid residues (e.g., H, or modified form thereof) or small amino acid residues (e.g., A, or modified form thereof);

$X_{19}$ is selected from acidic amino acid residues (e.g., D, or modified form thereof) or small amino acid residues (e.g., T or S, or modified form thereof);

$X_{20}$ is selected from acidic amino acid residues (e.g., E, or modified form thereof) or small amino acid residues (e.g., G or A, or modified form thereof);

$X_{21}$ is selected from acidic amino acid residues (e.g., D or E, or modified form thereof) or basic amino acid residues (e.g., K, or modified form thereof);

$X_{22}$ is selected from small amino acid residues (e.g., S or T, or modified form thereof);

$X_{23}$ is selected from small amino acid residues (e.g., G or A, or modified form thereof);

$X_{24}$ is selected from small amino acid residues (e.g., G or A, or modified form thereof);

$X_{25}$ is selected from small amino acid residues (e.g., G or A, or modified form thereof) or hydrophobic amino acid residues (e.g., aliphatic amino acid residues such as V, or modified form thereof);

$X_{26}$ is absent or selected from small amino acid residues (e.g., G, or modified form thereof);

$X_{27}$ is selected from acidic amino acid residues (e.g., E, or modified form thereof) or small amino acid residues (e.g., G, or modified form thereof);

$X_{28}$ is selected from small amino acid residues (e.g., A, or modified form thereof) or acidic amino acid residues (e.g., E, or modified form thereof);

$X_{29}$ is selected from hydrophobic amino acid residues (e.g., aliphatic amino acid residues such as I or M, or modified form thereof);

$X_{30}$ is selected from small amino acid residues (e.g., P, S or A, or modified form thereof);

$X_{31}$ is selected from acidic amino acid residues (e.g., D or E, or modified form thereof);

$X_{32}$ is selected from hydrophobic amino acid residues (e.g., aliphatic amino acid residues such as L or M, or modified form thereof) or basic amino acid residues (e.g., K, or modified form thereof);

$X_{33}$ is selected from charged amino acid residues (e.g., acidic amino acid residues such as E, or modified form thereof, or basic amino acid residues such as K, or modified form thereof) or small amino acid residues (e.g., G or A, or modified form thereof);

$X_{34}$ is selected from hydrophobic amino acid residues (e.g., aliphatic amino acid residues such as M or L, or modified form thereof);

$X_{35}$ is selected from acidic amino acid residues (e.g., E or D, or modified form thereof);

$X_{36}$ is selected from acidic amino acid residues (e.g., D or E, or modified form thereof);

$X_{37}$ is selected from hydrophobic amino acid residues (e.g., aliphatic amino acid residues such as L, or modified form thereof) or basic amino acid residues (e.g., R, or modified form thereof);

$X_{38}$ is selected from any amino acid residue (e.g., hydrophobic amino acid residues including aliphatic amino acid residues such as V, or modified form thereof, or small amino acid residues such as A or T, or modified form thereof, or basic amino acid residues such as H or modified form thereof, or acidic amino acid residues such as E or D, or modified form thereof);

$X_{39}$ is selected from acidic amino acid residues (e.g., D, or modified form thereof) or small amino acid residues (e.g., S or T, or modified form thereof);

$X_{40}$ is selected from small amino acid residues (e.g., T, or modified form thereof) or neutral/polar amino acid residues (e.g., N, or modified form thereof);

$X_{41}$ is selected from basic amino acid residues (e.g., K, R or H, or modified form thereof) or neutral/polar amino acid residues (e.g., Q, or modified form thereof);

$\Sigma$ is selected from small amino acid residues (e.g., S, A or T, or modified form thereof);

$X_{42}$ is selected from acidic amino acid residues (e.g., D or E, or modified form thereof) or small amino acid residues (e.g., S, T or A, or modified form thereof);

$X_{43}$ is selected from any amino acid residue (e.g., small amino acid residues such as P, G, T, S or A, or modified form thereof, or neutral/polar amino acid residues such as Q or N, or modified form thereof, basic amino acid residues such as H, K or R or modified form thereof, or acidic amino acid residues such as D or E, or modified form thereof);

$B_2$ is selected from basic amino acid residues (e.g., R or K, or modified form thereof);

$X_{44}$ is selected from small amino acid residues (e.g., A, or modified form thereof) or basic amino acid residues (e.g., K, or modified form thereof);

$X_{45}$ is selected from small amino acid residues (e.g., S or T, or modified form thereof);

$X_{46}$ is selected from acidic amino acid residues (e.g., D, or modified form thereof) or small amino acid residues (e.g., S, or modified form thereof);

$X_{47}$ is selected from small amino acid residues (e.g., G or S, or modified form thereof) or basic amino acid residues (e.g., K, or modified form thereof);

$X_{48}$ is selected from neutral/polar amino acid residues (e.g., Q, or modified form thereof) or acidic amino acid residues (e.g., E, or modified form thereof);

$X_{49}$ is selected from hydrophobic amino acid residues (e.g., aliphatic amino acid residues such as V, or modified form thereof) or small amino acid residues (e.g., A, or modified form thereof);

$X_{50}$ is selected from charged amino acid residues (e.g., acidic amino acid residues such as D, or modified form thereof, or basic amino acid residues such as H, or modified form thereof);

$X_{51}$ is selected from any amino acid residue (e.g., basic amino acid residues such as K, or modified form thereof, or neutral/polar amino acid residues such as N, or modified form thereof, or small amino acid residues such as T, or modified form thereof);

$X_{52}$ is selected from small amino acid residues (e.g., A, or modified form thereof) or hydrophobic amino acid residues (e.g., aliphatic amino acid residues such as L or M, or modified form thereof); and $X_{53}$ is selected from small amino acid residues (e.g., G or A, or modified form thereof), or (b) an amino acid sequence that shares at least 70% (and at least 71% to at least 99% and all integer percentages in between) sequence similarity or sequence identity with the amino acid sequence represented by formula VIII.

Suitably, Θ lacks or otherwise excludes a functional secretion-enhancing sequence, for example one selected from the group consisting of: KPTENNEDFNIVAVASNFATT [SEQ ID NO:106, secretion-enhancing sequence of *Gaussia princeps* Prolume, Prolume KDEL, Mutant 1 and Mutant 2 luciferases], ATINENFEDIDVVAIGGSFAL [SEQ ID NO:108, secretion-enhancing sequence of *Metridia pacifica* 2a luciferase], ATINENFEDIDLVAIGGSFAL [SEQ ID NO:110, secretion-enhancing sequence of *Metridia pacifica* 2bv1&2 luciferases], ATIQENFEDIDLVAIGGSFAS [SEQ ID NO:112, secretion-enhancing sequence of *Metridia longa* 22 luciferase], NPTENKDDIDIVGVEGKFGTTDLETDLFTIVEDMNVISRDTNLA [SEQ ID NO:114, secretion-enhancing sequence of *Metridia pacifica* v1&2&3 luciferases], NPTENNDHINIVGIEGKFGITDLETDLFTIWETNRMISTDNEQA [SEQ ID NO:116, secretion-enhancing sequence of *Metridia longa* 39]; NPTV [SEQ ID NO:118, secretion-enhancing sequence of *Metridia longa* 7 luciferase]; KTDIADTDRASNFVAT [SEQ ID NO:120, secretion-enhancing sequence of *Metridia longa* GS luciferase]; QKTDIADTDRASNFVAT [SEQ ID NO:122, secretion-enhancing sequence of *Metridia longa* 164M3 luciferase]; KSTEFDPNIDIVGLEGKFGITNLETDLFTIWETMEVMIKADIADTDRASNFVAT [SEQ ID NO:124, secretion-enhancing sequence of *Metridia longa* 164v1&2 luciferases]; KSTEFDPNIDIVGLEGKFGITNLETDLFTIWETMEVIKSDIADTDRVSNFVAT [SEQ ID NO:126, secretion-enhancing sequence of *Metridia longa* 16 luciferase]; KSTEFDPNIDIVGLEGKFGITNLETDLFTIWETMEVIKTDIADTDRARSFVAT [SEQ ID NO:128, secretion-enhancing sequence of *Metridia longa* 45 luciferase]; KSTEFDPNIDVVGLEGKFGITNLETDLFTIWETMEVIKTDIADTDRARNFVAT [SEQ ID NO:130, secretion-enhancing sequence of *Metridia longa* 52 luciferase]; and KSTEFDPNINIVGLEGKFGITNLETDLFTIWETMDVIKSDITDTDRVSNFVAT [SEQ ID NO:132, secretion-enhancing sequence of *Metridia longa* AL luciferase].

In some embodiments, the polypeptide is other than one consisting of the sequence:

```
                                     [SEQ ID NO: 134]
MDIKFIFALVCIALVQANPTVNNDVNRGKMPGKKLPLEVLIEMEANAFKA
GCTRGCLICLSKIKCTAKMKQYIPGRCHDYGGDKKTGQAGIVGAIVDIP
EISGFKEMEPMEQFIAQVDLCADCTTGCLKGLANVKCSELLKKWLPDR
CASFADKIQKEAHNIKGLAGDR
(full-length wild-type Metridia longa 7
luciferase).
```

In some embodiments, the amino acid sequence according to Θ further comprises upstream (e.g., immediately upstream) of the sequence represented by formula VIII an amino acid sequence represented by formula IX:

$$X_{54}X_{55}X_{56}X_{57}X_{58}RGO_1X_{59} \quad \text{(IX)}$$

wherein:

$X_{54}$ is absent or is selected from acidic amino acid residues (e.g., D or E, or modified form thereof) or neutral/polar amino acid residues (e.g., N, or modified form thereof), wherein $X_{54}$ is present in some embodiments with the proviso that $X_{55}$ is present;

$X_{55}$ is absent or is selected from any amino acid residue (e.g., hydrophobic amino acid residues including aliphatic amino acid residues such as L or V, or modified form thereof; small amino acid residues such as S, T or A, or modified form thereof; or neutral/polar amino acid residues such as N, or modified form thereof), wherein $X_{55}$ is present in some embodiments with the proviso that $X_{56}$ is present;

$X_{56}$ is absent or is selected from acidic amino acid residues (e.g., D or E, or modified form thereof), wherein $X_{56}$ is present in some embodiments with the proviso that $X_{57}$ is present;

$X_{57}$ is absent or is selected from any amino acid residue (e.g., hydrophobic amino acid residue including aliphatic amino acid residues such as V, or modified form thereof; or small amino acid residues such as S, T or A, or modified form thereof), wherein $X_{57}$ is present in some embodiments with the proviso that $X_{58}$ is present;

$X_{58}$ is selected from acidic amino acid residues (e.g., D or E, or modified form thereof) or neutral/polar amino acid residues (e.g., N, or modified form thereof), wherein $X_{58}$ is present in some embodiments with the proviso that $O_1$ is present;

$O_1$ is absent or is the sequence $J_1J_2J_3$, wherein $J_1$ is selected from small amino acid residues (e.g., G or modified form thereof), $J_2$ is selected from basic amino acid residues (e.g., H or modified form thereof), and $J_3$ is selected from small amino acid residues (e.g., G or modified form thereof), wherein $O_1$ is present in some embodiments with the proviso that $X_{59}$ is present; and $X_{59}$ is selected from basic amino acid residues (e.g., K, or modified form thereof); or small amino acid residues (e.g., G or modified form thereof).

In some embodiments, Θ comprises, consists or consists essentially of an amino acid sequence selected from:

(a) an amino acid sequence selected from:

DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDLCVDCTTGCLKGLANVQ
CSDLLKKWLPQRCATFASKIQGQVDKIKGAGGD
[SEQ ID NO: 46, intracellular *Gaussia princeps* Prolume luciferase];

DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDLCVDCTTGCLKGLANVQ
CSDLLKKWLPQRCATFASKIQGQVDKIKGAGGDKDEL
[SEQ ID NO: 48, intracellular *Gaussia princeps* Prolume KDEL luciferase];

DLDADRGKLPGKKLPLEVLKEIEANARKAGCTRGCLICLSHIKCTPKMKKF
IPGRCHTYEGDKESAQGGIGEAIVDIPEIPGFKDLEPMEQFIAQVDLCVDCTTGCLKGLANVQC
SDLLKKWLPQRCATFASKIQGQVDKIKGAGGD
[SEQ ID NO: 50, intracellular *Gaussia princeps* Mutant 1 luciferase];

DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDLCVDCTTGCLKGLANVQ
CSDLLKKWLPQRCATFASKIQGQVDKIKGAGGD
[SEQ ID NO: 52, intracellular *Gaussia princeps* Mutant 2 luciferase];

DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSALLKKWLPSRCKTFASKIQSQVDTIKGLAGDR
[SEQ ID NO: 136, intracellular *Metridia pacifica* 2a luciferase];

DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSDLLKKWLPSRCKTFASKIQSQVDTIKGLAGDR
[SEQ ID NO: 138, intracellular *Metridia pacifica* 2bv1 luciferase];

DVDANRGGHGGHPGKKMPKEVPVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVHCSDLLKKWLPSRCKTFASKIQSQVDTIKGLAGDR
[SEQ ID NO: 140, intracellular *Metridia pacifica* 2bv2 luciferase];

DVDANRGGHGGHPGKKMPKEVLMEMEANAKRAGCHRGCLVCLSHIKCT
AQMQKFIPGRCHSYAGDKDSAQGGIAGGAIVDIPEIAGFKEMKPMEQFIAQVDLCEDCTTGCL
KGLANVHCSDLLKKWLPSRCKTFASKIQSQVDTIKGLAGDR
[SEQ ID NO: 142, intracellular *Metridia longa* 22 luciferase];
and NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSALLKKWLPDRCASFADKIQSEVDNIKGLAGDR
[SEQ ID NO: 144, intracellular *Metridia pacifica* v1&2&3 luciferases];

NTDSNRGKMPGKKLPLAVLIEMEANAFKAGCTRGCLICLSKIKCTAKMKK
YIPGRCHDYGGDKKTGQAGIVGAIVDIPDISGFKEMGPMEQFIAQVDRCTDCTTGCLKGLAN
VKCSELLKKWLPDRCASFADKIQSEVHNIKGLAGDR
[SEQ ID NO: 146, intracellular *Metridia longa* 39 luciferase];

NNDVNRGKMPGKKLPLEVLIEMEANAFKAGCTRGCLICLSKIKCTAKMKQ
YIPGRCHDYGGDKKTGQAGIVGAIVDIPEISGFKEMEPMEQFIAQVDLCADCTTGCLKGLANV
KCSELLKKWLPDRCASFADKIQKEAHNIKGLAGDR
[SEQ ID NO: 148, intracellular *Metridia longa* 7 luciferase];

ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCASCTTGCLKGLAN
VKCSELLKKWLPDRCASFADKIQKEVHNIKGMAGDR
[SEQ ID NO: 150] (intracellular *Metridia longa* GS luciferase);

ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCASCTTGCLKGLAN
VKCSELLKKWLPDRCASFADKIQKEVHNIKGMAGDR
[SEQ ID NO: 152, intracellular *Metridia longa* 164M3&v1 luciferases];

ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVERCASCTTGCLKGLAN
VKCSELLKKWLPDRCASFADKIQKEVHNIKGMAGDR
[SEQ ID NO: 154, intracellular *Metridia longa* 164v2 luciferase];

-continued

ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCTSCTTGCLKGLAN
VKCSELLKKWLPDRCASFADKIQKEVHNIKGMAGDR
[SEQ ID NO: 156, intracellular *Metridia longa* 16 luciferase];

ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCASCTTGCLKGLAN
VKCSELLKKWLPDRCASFADKIQKEVHNIKGMAGDR
[SEQ ID NO: 158, intracellular *Metridia longa* 45 luciferase];

ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCASCNTGCLKGLAN
VKCSELLKKWLPDRCASFADKIQKEVHNIKGMAGDR
[SEQ ID NO: 160, intracellular *Metridia longa* 52 luciferase];

ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDLCATCTTGCLKGLAN
VKCSELLKKWLPGRCASFADKIQKEVHNIKGMAGDR
[SEQ ID NO: 162, intracellular *Metridia longa* AL luciferase];

EAEAERGKLPGKKLPLEVLIEMEANARKAGCTRGCLICLSKIKCTAKMKK
YIPGRCADYGGDKKTGQAGIVGAIVDIPEISGFKEMEPMEQFIAQVDRCADCTTGCLKGLANV
KCSDLLKKWLPGRCATFADKIQSEVDNIKGLAGDR
[SEQ ID NO: 82, intracellular *Metridia longa* GS2 luciferase];

(b) an amino acid sequence that shares at least 70% (and at least 71% to at least 99% and all integer percentages in between) sequence similarity or sequence identity with the sequence set forth in any one of SEQ ID NO: 46, 48, 50, 52, 82, 136, 138, 140, 142, 144, 146, 148, 150, 152, 154, 156, 158, 160 or 162; or (c) an amino acid sequence which is encoded by the nucleotide sequence set forth in any one of:

[SEQ ID NO: 45]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Prolume
luciferase);

[SEQ ID NO: 47]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ayaargaygarytn
(nucleotide sequence encoding intracellular *Gaussia princeps*
Prolume KDEL luciferase);

[SEQ ID NO: 49]

gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 1
luciferase);

[SEQ ID NO: 51]

gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnytngarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 2
luciferase);

-continued

[SEQ ID NO: 135]

gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngcnytnytnaaraartggytnccnwsnmgntgyaaracnttygcnwsnaarathcarwsncargtngayacnathaarggn
ytngcnggngaymgn (nucleotide sequence encoding intracellular *Metridia pacifica* 2a luciferase);

[SEQ ID NO: 137]

gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngayytnytnaaraartggytnccnwsnmgntgyaaracnttygcnwsnaarathcarwsncargtngayacnathaarggn
ytngcnggngaymgn (nucleotide sequence encoding intracellular *Metridia pacifica* 2bv1 luciferase);

[SEQ ID NO: 139]

gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngayytnytnaaraartggytnccnwsnmgntgyaaracnttygcnwsnaarathcarwsncargtngayacnathaarggn
ytngcnggngaymgn (nucleotide sequence encoding intracellular *Metridia pacifica* 2bv2 luciferase);

[SEQ ID NO: 141]

gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgycaywsntaygcnggngayaargaywsngcncarggnggnathgcnggnggngcnathgtngayathccngarath
gcnggnttyaargaratgaarccnatggarcarttyathgcncargtngayytntgygargaytgyacnacnggntgyytnaarggnytngcna
aygtncaytgywsngayytnytnaaraartggytnccnwsnmgntgyaaracnttygcnwsnaarathcarwsncargtngayacnathaa
rggnytngcnggngaymgn (nucleotide sequence encoding intracellular *Metridia longa* 22 luciferase);

[SEQ ID NO: 143]

aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcantyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn (nucleotide sequence encoding intracellular *Metridia pacifica* v1&2&3 luciferases);

[SEQ ID NO: 145]

aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgycaygaytayggnggngayaaraaracnggncargcnggnathgtnggngcnathgtngayathccngayathwsnggnttyaargar
atgggnccnatggarcarttyathgcncargtngaymgntgyacngaytgyacnacnggntgyytnaarggnytngcnaaygtnaartgyws
ngarytnytnaaraartggytnccngaymgntgygcnwsnttygcngayaarathcarwsngargtncayaayathaarggnytngcnggn
gaymgn (nucleotide sequence encoding intracellular *Metridia longa* 39 luciferase);

[SEQ ID NO: 147]

aayaaygaygtnaaymgnggnaaratgccnggnaaraarytnccnytngargtnymathgaratggargcnaa
ygcnttyaargcnggntgyacnmgnggntgyytnathtgyytnwsnaarathaartgyacngcnaaratgaarcartayathccnggnmgnt
gycaygaytayggnggngayaaraaracnggncargcnggnathgtnggngcnathgtngayathccngarathwsnggnttyaargarat
ggarccnatggarcarttyathgcncargtngayytntgygcngaytgyacnacnggntgyytnaarggnytngcnaaygtnaartgywsng
arytnytnaaraartggytnccngaymgntgygcnwsnttygcngayaarathcaraargargcncayaayathaarggnytngcnggngay
mgn (nucleotide sequence encoding intracellular *Metridia longa* 7 luciferase);

[SEQ ID NO: 149]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* GS luciferase);

-continued

[SEQ ID NO: 151]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 164M3&v1 luciferase);

[SEQ ID NO: 153]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia langa* 164v2 luciferase);

[SEQ ID NO: 155]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgyacnwsntgyacnacnggntgyytnaarggnytngcnaaygtnaartgywsn
garytnynaaraartggytnccngaymgntgygcnwsnttygcngayaarathcaraargargtncayaayathaarggnatggcnggnga
ymgn (nucleotide sequence encoding intracellular *Metridia longa* 16 luciferase);

[SEQ ID NO: 157]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 45 luciferase];

[SEQ ID NO: 159]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcnwsntgyaayacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 52 luciferase);

[SEQ ID NO: 161]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngayytntgygcnacntgyacnacnggntgyytnaarggnytngcnaaygtnaartgywsng
arytnytnaaraartggytnccnggnmgntgygtcnwsnttygcngayaarathcaraargargtncayaayathaarggnatggcnggngay
mgn (nucleotide sequence encoding intracellular *Metridia longa* AL luciferase), or

[SEQ ID NO: 81]

gargcngargcngarmgnggnaarytnccnggnaaraarytnccnytngargtnytnathgaratggargcnaay
gcnmgnaargcnggntgyacnmgnggntgyytnathtgyytnwsnaarathaartgyacngcnaaratgaaraartayathccnggnmgn
tgygcngaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccnaaymgntgygcnwsnttygcngayaarathcarwsngargtngayaayathaarggnytngcnggng
aymgn (nucleotide sequence encoding intracellular *Metridia longa* GS2 luciferase), or a complement of any one of 45, 47, 49, 51, 81, 135, 137, 139, 141, 143, 145, 147, 149, 151, 153, 155, 157, 159 or 161;

(d) an amino acid sequence which is encoded by a nucleotide sequence that shares at least 70% (and at least 71% to at least 99% and all integer percentages in between) sequence identity with the sequence set forth in any one of SEQ ID NO: 45, 47, 49, 51, 81, 135, 137, 139, 141, 143, 145, 147, 149, 151, 153, 155, 157, 159 or 161, or a complement thereof; or (e) an amino acid sequence which is encoded by a nucleotide sequence that hybridizes under at least medium or high stringency conditions to the sequence set forth in any one of SEQ ID NO: 45, 47, 49, 51, 81, 135, 137, 139, 141, 143, 145, 147, 149, 151, 153, 155, 157, 159 or 161, or a complement thereof.

In some embodiments, the signal peptide comprises an amino acid sequence represented by formula IV as broadly described above, non-limiting examples include (a) an amino acid sequence as set forth in SEQ ID NO: 84, 86, 88, 90, 92, 94, 96, 98, 100, 102 or 104, or (b) an amino acid sequence that shares at least 70% (and at least 71% to at least 99% and all integer percentages in between) sequence similarity or sequence identity with the sequence set forth in any one of SEQ ID NO: 84, 86, 88, 90, 92, 94, 96, 98, 100, 102 or 104, or an amino acid sequence which is encoded by the nucleotide sequence set forth in any one of SEQ ID NO: 83, 85, 87, 89, 91, 93, 95, 97, 99, 101 or 103, or (d) an amino acid sequence which is encoded by a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof, or (e) an amino acid sequence which is encoded by a nucleotide sequence that hybridizes under at least medium or high stringency conditions to the sequence set forth in any one of SEQ ID NO: 83, 85, 87, 89, 91, 93, 95, 97, 99, 101 or 103, or a complement thereof.

In some embodiments, the polypeptide according to formula VIII lacks a signal peptide for secreting the polypeptide to an extracellular location.

In some embodiments, $X_1$ in formula VIII is L or modified form thereof.

In some embodiments, $X_{18}$ is other than H.

In some embodiments, $X_{18}$ is selected from small amino acid residues (e.g., A, S or T, or modified form thereof) or acidic amino acid residues (e.g., E or modified form thereof).

In specific embodiments, $X_{18}$ is A or modified form thereof.

In some embodiments, the subsequence $B_1C_5X_{18}X_{19}$ consists of an amino acid sequence represented by formula V:

BCΩΩ (V)

wherein:

B is selected from basic amino acid residues (e.g., R or K, or modified form thereof); and Ω is selected from small amino acid residues (e.g., A, S or T, or modified form thereof) or acidic amino acid residues (e.g., D or E, or modified form thereof)

In specific embodiments, $X_{18}$ is A or modified form thereof.

In some embodiments, $X_{19}$ is selected from small amino acid residues (e.g., T or S, or modified form thereof).

In some embodiments, the subsequence $B_1C_5X_{18}X_{19}$ is selected from RCAD, KCAD, RCED, KCED, RCSD, KCSD, RCTD, KCTD, RCAT or RCAS.

In some embodiments, $X_{37}$ is selected from basic amino acid residues (e.g., R or K, or modified form thereof) or neutral polar amino acid residues (e.g., Q or modified form thereof).

In some embodiments, $X_{38}$ is selected from A or E, or modified form.

In some embodiments, $X_{39}$ is D or modified form thereof.

In some embodiments, the subsequence $X_{37}C_6X_{38}X_{39}$ is selected from RCAD or RCED.

In some embodiments, $X_{41}$ is selected from basic amino acid residues (e.g., K or R, or modified form thereof).

In some embodiments, Σ is selected from S or T, or modified form thereof.

In some embodiments, $X_{42}$ is selected from D, or modified form thereof.

In some embodiments, the subsequence $X_{41}C_9\Sigma X_{42}$ is KCSD.

In some embodiments, at least one subsequence of the polypeptides selected from $B_1C_5X_{18}X_{19}$, $X_{37}C_6X_{38}X_{39}$ and $X_{41}C_9\Sigma X_{42}$ consists of an amino acid sequence represented by formula VI:

BCΩD (VI)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

In illustrative examples of this type, the subsequence $B_1C_5X_{18}X_{19}$ is selected from RCAD, KCAD, RCED, KCED, RCSD, KCSD, RCTD and KCTD.

In illustrative examples, the subsequence $X_{37}C_6X_{38}X_{39}$ is selected from RCAD, KCAD, RCED, KCED, RCSD, KCSD, RCTD and KCTD.

In illustrative examples, the subsequence $X_{41}C_9\Sigma X_{42}$ consists of the sequence KCSD.

In some embodiments, $X_{43}$ is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof.

In some embodiments, at least 1, 2, 3 or all 4 subsequence(s) selected from $B_1C_5X_{18}X_{19}$, $X_{37}C_6X_{38}X_{39}$, $X_{41}C_9\Sigma X_{42}$ and $B_2C_{10}X_{44}X_{45}$ consist(s) of an amino acid sequence represented by formula V (i.e., BCΩΩ) as defined above. In illustrative examples of this type, the amino acid sequence represented by formula V is selected from BCAD (e.g., RCAD, KCAD), BCAT (e.g., RCAT, KCAT), BCED (e.g., RCED, KCED), BCSD (e.g., RCSD, KCSD), BCTD (e.g., RCTD, KCTD), and BCAS (e.g., RCAS, KCAS).

In some embodiments, one or both of $X_{37}C_6$ and $X_{41}C_9$ consists of an amino acid sequence represented by formula XX:

BC (XX)

wherein:

B is selected from basic amino acid residues (e.g., R or K, or modified form thereof).

In some illustrative examples of these embodiments, at least 1, 2, 3 or all subsequence(s) selected from $B_1C_5$, $X_{37}C_6$, $X_{41}C_9$ and $B_2C_{10}$ are present within a subsequence consisting of the amino acid sequence represented by formula XXI:

BCΩ (XXI)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

In these examples, BCΩ suitably consists of a sequence selected from BCA or BCE.

In some embodiments, at least 1, 2, 3 or all subsequence(s) selected from $B_1C_5X_{18}$, $X_{37}C_6X_{38}$, $X_{41}C_9\Sigma$ and $B_2C_{10}X_{44}$ consist of an amino acid sequence represented by formula XXII:

BCA (XXII)

wherein:

B is selected from basic amino acid residues (e.g., R or K, or modified form thereof).

In some illustrative examples of these embodiments, the amino acid sequence BCA is present within a subsequence selected from BCAD or BCAT. In these examples, the subsequence $B_1C_5X_{18}X_{19}$ is suitably represented by BCAD or BCAT. Suitably, the subsequence $B_2C_{10}X_{44}$ is represented by BCAT.

In some illustrative examples of these embodiments, the amino acid sequence BCA is present within the subsequence GBCAT. In these examples, the subsequence GBCAT suitably represents one or both of the subsequences $GB_1C_5X_{18}X_{19}$ and $X_{43}B_2C_{10}X_{44}$.

In some embodiments, the subsequence $X_{42}$ is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof. In some illustrative examples of these embodiments, the subsequence $B_2C_{10}X_{44}$ is represented by BCA or the subsequence $B_2C_{10}X_{44}X_{45}$ is represented by BCAT.

In some embodiments, one or both of $X_{36}X_{37}C_6$ and $X_{43}B_2C_{10}$ consists of an amino acid sequence represented by formula XXIII:

EBC (XXIII)

wherein:

B is selected from basic amino acid residues (e.g., R or K, or modified form thereof).

In some embodiments, $X_{43}B_2C_{10}$ consists of an amino acid sequence represented by formula XXIV:

GBC (XXIV)

wherein:

B is selected from basic amino acid residues (e.g., R or K, or modified form thereof).

In some illustrative examples of these embodiments, one or both of $GB_1C$ and $X_{43}B_2C_{10}$ are present within a subsequence represented by formula XXV:

GBCΩ (XXV)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

Suitably, GBCΩ is GBCA.

In some illustrative examples of these embodiments, one or both of $GB_1C$ and $X_{43}B_2C_{10}$ are present within a subsequence represented by formula XXVI:

GBCΩΩ (XXVI)

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof).

Suitably, GBCΩΩ is GBCAT.

In some embodiments, polypeptides comprising an amino acid sequence according to Θ have any one or more activities selected from the group consisting of: enhanced luminescence, stronger flash signal intensity, enhanced glow signal intensity, enhanced stability of glow signal and enhanced effective temperature range, including elevated optimal temperature range; for operation of the enzyme relative to a reference luciferase polypeptide which comprises a functional secretion-enhancing sequence.

In a related aspect, the present invention provides isolated, synthetic, recombinant or purified nucleic acid molecules that comprise, consist or consist essentially of a nucleotide sequence encoding the amino acid sequence of a polypeptide according to formula VII as broadly described above, or any one of the embodiments relating to formula VII. In some embodiments, the nucleic acid molecules comprise, consist or consist essentially of a nucleotide sequence selected from the group consisting of (a) a nucleotide sequence that encodes an amino acid sequence selected from any one of SEQ ID NO: 46, 48, 50, 52, 82, 136, 138, 140, 142, 144, 146, 148, 150, 152, 154, 156, 158, 160 or 162;

(b) a nucleotide sequence selected from: SEQ ID NO:45 (nucleotide sequence encoding intracellular *Gaussia princeps* Prolume luciferase), SEQ ID NO:47 (nucleotide sequence encoding intracellular *Gaussia princeps* Prolume KDEL luciferase), SEQ ID NO:49 (nucleotide sequence encoding intracellular *Gaussia princeps* Mutant 1 luciferase), SEQ ID NO:51 (nucleotide sequence encoding intracellular *Gaussia princeps* Mutant 2 luciferase), SEQ ID NO:135 (nucleotide sequence encoding intracellular *Metridia pacifica* 2a luciferase), SEQ ID NO:137 (nucleotide sequence encoding intracellular *Metridia pacifica* 2bv1 luciferase), SEQ ID NO:139 (nucleotide sequence encoding intracellular *Metridia pacifica* 2bv2 luciferase), SEQ ID NO:141 (nucleotide sequence encoding intracellular *Metridia longa* 22 luciferase), SEQ ID NO:143 (nucleotide sequence encoding intracellular *Metridia pacifica v*1&2&3 luciferases), SEQ ID NO:145 (nucleotide sequence encoding intracellular *Metridia longa* 39 luciferase), SEQ ID NO:147 (nucleotide sequence encoding intracellular *Metridia longa* 7 luciferase), SEQ ID NO:149 (nucleotide sequence encoding intracellular *Metridia longa* GS luciferase), SEQ ID NO:151 (nucleotide sequence encoding intracellular *Metridia longa* 164M3&v1 luciferase), SEQ ID NO:153 (nucleotide sequence encoding intracellular *Metridia longa* 164v2 luciferase), SEQ ID NO:155 (nucleotide sequence encoding intracellular *Metridia longa* 16 luciferase), SEQ ID NO:157 (nucleotide sequence encoding intracellular *Metridia longa* 45 luciferase], SEQ ID NO:159 (nucleotide sequence encoding intracellular *Metridia longa* 52 luciferase), SEQ ID NO:161 (nucleotide sequence encoding intracellular *Metridia longa* AL luciferase), or SEQ ID NO:81 (nucleotide sequence encoding intracellular *Metridia longa* GS luciferase), or a complement thereof;

(b) a nucleotide sequence that shares at least 70% (and at least 71% to at least 99% and all integer percentages in between) sequence identity with the sequence set forth in any one of SEQ ID NO: 45, 47, 49, 51, 81, 135, 137, 139, 141, 143, 145, 147, 149, 151, 153, 155, 157, 159 or 161, or a complement thereof; or (c) a nucleotide sequence that hybridizes under at least low, medium or high stringency conditions to the sequence set forth in any one of SEQ ID NO: 45, 47, 49, 51, 81, 135, 137, 139, 141, 143, 145, 147, 149, 151, 153, 155, 157, 159 or 161, or a complement thereof.

In some embodiments, the nucleic acid molecules further comprise a nucleotide sequence encoding a signal peptide, representative examples of which are selected from:

(a) a nucleotide sequence that encodes an amino acid sequences selected from any one of 82, 84, 86, 88, 90, 92, 94, 96, 98, 100 or 102;

(b) a nucleotide sequence as set forth in any one of SEQ ID NO:83 (nucleotide sequence encoding signal peptide of *Gaussia princeps* Prolume, Prolume KDEL, Mutant 1 or Mutant 2 luciferases), SEQ ID NO:85 (nucleotide sequence encoding signal peptide of *Metridia pacifica* 2a, 2bv1, 2bv2 or *Metridia longa* 22 luciferases), SEQ ID NO:87 (nucleotide sequence encoding signal peptide of *Metridia pacifica* 1v1 luciferase), SEQ ID NO:89 (nucleotide sequence encoding signal peptide of *Metridia pacifica* 1v2 luciferase), SEQ ID NO:91 (nucleotide sequence encoding signal peptide of *Metridia pacifica* 1v3 luciferase), SEQ ID NO:93 (nucleotide sequence encoding signal peptide of *Metridia longa* 39 luciferase), SEQ ID NO:95 (nucleotide sequence encoding signal peptide of *Metridia longa* 7 luciferase), SEQ ID NO:97 (nucleotide sequence encoding signal peptide of *Metridia longa* 164M3, v1 or v2 luciferases), SEQ ID NO:99 (nucleotide sequence encoding signal peptide of *Metridia longa* 16 luciferase), SEQ ID NO:101 (nucleotide sequence encoding signal peptide of *Metridia longa* 45 and 52 luciferases) or SEQ ID NO:103 (nucleotide sequence encoding signal peptide of *Metridia longa* AL luciferase), or a complement thereof;

(b) a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof; or (c) a nucleotide sequence that hybridizes under at least low, medium or high stringency conditions to the sequence set forth in any one of SEQ ID NO: 83, 85, 87, 89, 91, 93, 95, 97, 99, 101 or 103, or a complement thereof.

Suitably, the nucleic acid molecules exclude a nucleotide sequence encoding a secretion-enhancing sequence, representative examples of which include:

a nucleotide sequence as set forth in any one of SEQ ID NO:105 (nucleotide sequence encoding secretion-enhancing sequence of *Gaussia princeps* Prolume, Prolume KDEL, Mutant 1 and Mutant 2 luciferases), SEQ ID NO:107 (nucleotide sequence encoding secretion-enhancing sequence of *Metridia pacifica* 2a luciferase), SEQ ID NO:109 (nucleotide sequence encoding secretion-enhancing sequence of *Metridia pacifica* 2bv1&2 luciferases), SEQ ID NO:111 (nucleotide sequence encoding secretion-enhancing sequence of *Metridia longa* 22 luciferase), SEQ ID NO:113 (nucleotide sequence encoding secretion-enhancing sequence of *Metridia pacifica* v1&2&3 luciferases), SEQ ID NO:115 (nucleotide sequence encoding secretion-enhancing sequence of *Metridia longa* 39 luciferase), SEQ ID NO:117 (nucleotide sequence encoding secretion-enhancing sequence of *Metridia longa* GS), SEQ ID NO:119 (nucleotide sequence encoding secretion-enhancing sequence of *Metridia longa* 7 luciferase), SEQ ID NO:121 (nucleotide sequence encoding secretion-enhancing sequence of *Metridia longa* 164M3 luciferase), SEQ ID NO:123 (nucleotide sequence encoding secretion-enhancing sequence of *Metridia longa* 164v1&2 luciferases), SEQ ID NO:125 (nucleotide sequence encoding secretion-enhancing sequence of *Metridia longa* 16 luciferase), SEQ ID NO:127 (nucleotide sequence encoding secretion-enhancing sequence of *Metridia longa* 45 luciferase), SEQ ID NO:129 (nucleotide sequence encoding secretion-enhancing sequence of *Metridia longa* 52 luciferase), SEQ ID NO:131 (nucleotide sequence encoding secretion-enhancing sequence of *Metridia longa* AL luciferase).

In some embodiments, the polypeptide encoded by a nucleic acid molecule as broadly described above has any one or more activities selected from the group consisting of: enhanced luminescence, stronger flash signal intensity, enhanced glow signal intensity, enhanced stability of glow signal and enhanced effective temperature range, including elevated optimal temperature range, for operation of the enzyme relative to a reference luciferase polypeptide which comprises a functional secretion enhancing sequence.

The present inventors have also discovered that modification of certain 4-residue motifs, which include a conserved cysteine (e.g., $C_5$, $C_6$, $C_9$ and $C_{10}$, can significantly improve one or more light-emitting characteristics of luciferases, especially copepod luciferases, wherein the light-emitting characteristics are selected from: luminescence, flash signal intensity, glow signal intensity, glow signal stability and effective temperature range, including elevated optimal temperature range, of luciferase operation. Accordingly, in yet another aspect, the present invention provides polypeptides, which are suitably in isolated, synthetic, recombinant or purified form, which comprise, consist or consist essentially of an amino acid sequence having luciferase activity, wherein the amino acid sequence is selected from:

(a) an amino acid sequence represented by formula X:

(X)

$X_1PGKKX_2PX_3X_4VX_5X_6EX_7EANAX_8X_9AGC_1X_{10}RGC_2LX_{11}C_3LS$ $X_{12}IKC_4TX_{13}X_{14}MX_{15}X_{16}X_{17}IPG\mathbf{B_1C_5X_{18}X_{19}}YX_{20}GDKX_{21}X_{22}$ $X_{23}QX_{24}GIX_{25}X_{26}X_{27}X_{28}IVDX_{29}PEIX_{30}GFKX_{31}X_{32}X_{33}PX_{34}$ $X_{35}QFIAQVX_{36}\mathbf{X_{37}C_6X_{38}X_{39}}C_7X_{40}TGC_8LKGLANV\mathbf{X_{41}C_9}\Sigma\mathbf{X_{42}}$ $LLKKWLPX_{43}B_2C_{10}X_{44}X_{45}FAX_{46}KIQX_{47}X_{48}X_{49}X_{50}X_{51}\mathbf{IKG}X_{52}$ $X_{53}GD$ wherein:

$X_1$ is selected from hydrophobic amino acid residues (e.g., aliphatic amino acid residues such as L or M, or modified form thereof) or basic amino acid residues (e.g., H, or modified form thereof);

$X_2$ is selected from hydrophobic amino acid residues (e.g., aliphatic amino acid residues such as L or M, or modified form thereof);

$X_3$ is selected from hydrophobic amino acid residues (e.g., aliphatic amino acid residues such as L, or modified form thereof) or basic amino acid residues (e.g., K, or modified form thereof);

$X_4$ is selected from hydrophobic amino acid residues (e.g., aliphatic amino acid residues such as A, or modified form thereof) or acidic amino acid residues (e.g., E, or modified form thereof);

$X_5$ is selected from hydrophobic amino acid residues (e.g., aliphatic amino acid residues such as I or L, or modified form thereof) or small amino acid residues (e.g., P, or modified form thereof);

$X_6$ is selected from hydrophobic amino acid residues (e.g., aliphatic amino acid residues such as I, M or V, or modified form thereof) or basic amino acid residues (e.g., K, or modified form thereof);

$X_7$ is selected from hydrophobic amino acid residues (e.g., aliphatic amino acid residues such as M, I or L, or modified form thereof);

$X_8$ is selected from basic amino acid residues (e.g., K or R, or modified form thereof) or hydrophobic amino acid residues (e.g., aromatic amino acid residues such as F, or modified form thereof);

$X_9$ is selected from basic amino acid residues (e.g., K or R, or modified form thereof);

$X_{10}$ is selected from small amino acid residues (e.g., T, or modified form thereof) or basic amino acid residues (e.g., H, or modified form thereof);

$X_{11}$ is selected from hydrophobic amino acid residues (e.g., aliphatic amino acid residues such as I or V, or modified form thereof);

$X_{12}$ is selected from basic amino acid residues (e.g., H or K, or modified form thereof);

$X_{13}$ is selected from small amino acid residues (e.g., P or A, or modified form thereof) or basic amino acid residues (e.g., K, or modified form thereof);

$X_{14}$ is selected from basic amino acid residues (e.g., K, or modified form thereof) or neutral/polar amino acid residues (e.g., Q, or modified form thereof);

$X_{15}$ is selected from basic amino acid residues (e.g., K, or modified form thereof) or neutral/polar amino acid residues (e.g., Q, or modified form thereof);

$X_{16}$ is selected from any amino acid residue (e.g., basic amino acid residues such as K, or modified form thereof, hydrophobic amino acid residues including aliphatic amino acid residues such as V, or modified form thereof, or neutral/polar amino acid residues such as Q, or modified form thereof);

$B_1$ is selected from basic amino acid residues (e.g., R or K, or modified form thereof);

$X_{17}$ is selected from hydrophobic amino acid residues (e.g., aromatic amino acid residues such as F or Y, or modified form thereof);

$X_{18}$ is selected from basic amino acid residues (e.g., H, or modified form thereof) or small amino acid residues (e.g., A, or modified form thereof);

$X_{19}$ is selected from acidic amino acid residues (e.g., D, or modified form thereof) or small amino acid residues (e.g., T or S, or modified form thereof);

$X_{20}$ is selected from acidic amino acid residues (e.g., E, or modified form thereof) or small amino acid residues (e.g., G or A, or modified form thereof);

$X_{21}$ is selected from acidic amino acid residues (e.g., D or E, or modified form thereof) or basic amino acid residues (e.g., K, or modified form thereof);

$X_{22}$ is selected from small amino acid residues (e.g., S or T, or modified form thereof);

$X_{23}$ is selected from small amino acid residues (e.g., G or A, or modified form thereof);

$X_{24}$ is selected from small amino acid residues (e.g., G or A, or modified form thereof);

$X_{25}$ is selected from small amino acid residues (e.g., G or A, or modified form thereof) or hydrophobic amino acid residues (e.g., aliphatic amino acid residues such as V, or modified form thereof);

$X_{26}$ is absent or selected from small amino acid residues (e.g., G, or modified form thereof);

$X_{27}$ is selected from acidic amino acid residues (e.g., E, or modified form thereof) or small amino acid residues (e.g., G, or modified form thereof);

$X_{28}$ is selected from small amino acid residues (e.g., A, or modified form thereof) or acidic amino acid residues (e.g., E, or modified form thereof);

$X_{29}$ is selected from hydrophobic amino acid residues (e.g., aliphatic amino acid residues such as I or M, or modified form thereof);

$X_{30}$ is selected from small amino acid residues (e.g., P, S or A, or modified form thereof);

$X_{31}$ is selected from acidic amino acid residues (e.g., D or E, or modified form thereof);

$X_{32}$ is selected from hydrophobic amino acid residues (e.g., aliphatic amino acid residues such as L or M, or modified form thereof) or basic amino acid residues (e.g., K, or modified form thereof);

$X_{33}$ is selected from charged amino acid residues (e.g., acidic amino acid residues such as E, or modified form thereof, or basic amino acid residues such as K, or modified form thereof) or small amino acid residues (e.g., G or A, or modified form thereof);

$X_{34}$ is selected from hydrophobic amino acid residues (e.g., aliphatic amino acid residues such as M or L, or modified form thereof);

$X_{35}$ is selected from acidic amino acid residues (e.g., E or D, or modified form thereof);

$X_{36}$ is selected from acidic amino acid residues (e.g., D or E, or modified form thereof);

$X_{37}$ is selected from hydrophobic amino acid residues (e.g., aliphatic amino acid residues such as L, or modified form thereof) or basic amino acid residues (e.g., R, or modified form thereof);

$X_{38}$ is selected from any amino acid (e.g., hydrophobic amino acid residues including aliphatic amino acid residues such as V, or modified form thereof, or small amino acid residues such as A or T, or modified form thereof, or basic amino acid residues such as H or modified form thereof, or acidic amino acid residues such as E or D, or modified form thereof);

$X_{39}$ is selected from acidic amino acid residues (e.g., D, or modified form thereof) or small amino acid residues (e.g., S or T, or modified form thereof);

$X_{40}$ is selected from small amino acid residues (e.g., T, or modified form thereof) or neutral/polar amino acid residues (e.g., N, or modified form thereof);

$X_{41}$ is selected from basic amino acid residues (e.g., K, R or H, or modified form thereof) or neutral/polar amino acid residues (e.g., Q, or modified form thereof);

Σ is selected from small amino acid residues (e.g., S, A or T, or modified form thereof);

$X_{42}$ is selected from acidic amino acid residues (e.g., D or E, or modified form thereof) or small amino acid residues (e.g., A, or modified form thereof);

$X_{43}$ is selected from any amino acid residue (e.g., small amino acid residues such as P, G, T, S or A, or modified form thereof, or neutral/polar amino acid residues such as Q or N, or modified form thereof, basic amino acid residues such as H, K or R or modified form thereof, or acidic amino acid residues such as D or E, or modified form thereof);

$B_2$ is selected from basic amino acid residues (e.g., R or K, or modified form thereof);

$X_{44}$ is selected from small amino acid residues (e.g., A, or modified form thereof) or basic amino acid residues (e.g., K, or modified form thereof);

$X_{45}$ is selected from small amino acid residues (e.g., S or T, or modified form thereof);

$X_{46}$ is selected from acidic amino acid residues (e.g., D, or modified form thereof) or small amino acid residues (e.g., S, or modified form thereof);

$X_{47}$ is selected from small amino acid residues (e.g., G or S, or modified form thereof) or basic amino acid residues (e.g., K, or modified form thereof);

$X_{48}$ is selected from neutral/polar amino acid residues (e.g., Q, or modified form thereof) or acidic amino acid residues (e.g., E, or modified form thereof);

$X_{49}$ is selected from hydrophobic amino acid residues (e.g., aliphatic amino acid residues such as V, or modified form thereof) or small amino acid residues (e.g., A, or modified form thereof);

$X_{50}$ is selected from charged amino acid residues (e.g., acidic amino acid residues such as D, or modified form thereof, or basic amino acid residues such as H, or modified form thereof);

$X_{51}$ is selected from any amino acid residue (e.g., basic amino acid residues such as K, or modified form thereof, or neutral/polar amino acid residues such as N, or modified form thereof, or small amino acid residues such as T, or modified form thereof);

$X_{52}$ is selected from small amino acid residues (e.g., A, or modified form thereof) or hydrophobic amino acid residues (e.g., aliphatic amino acid residues such as L or M, or modified form thereof); and $X_{53}$ is selected from small amino acid residues (e.g., G or A, or modified form thereof), with the proviso that at least one subsequence selected from $B_1C_5X_{18}X_{19}$, $X_{37}C_6X_{38}X_{39}$ or $X_{41}C_9\Sigma X_{42}$ consists of an amino acid sequence represented by formula XI:

$$BC\Omega D \qquad (XI)$$

wherein:

B is selected from basic amino acid residues (e.g., R or K, or modified form thereof); and Ω is selected from small amino acid residues (e.g., A, S or T, or modified form thereof) or acidic amino acid residues (e.g., E, or modified form thereof), or (b) an amino acid sequence which shares at least 70% (and at least 71% to at least 99% and all integer percentages in between) sequence similarity or sequence identity with the amino acid sequence represented by formula X, and which comprises at least one subsequence selected from $B_1C_5X_{18}X_{19}$, $X_{37}C_6X_{38}X_{39}$ or $X_{41}C_9\Sigma X_{42}$ wherein an individual subsequence consists of an amino acid sequence represented by formula XI as defined above.

In some embodiments, the polypeptide is other than one consisting of an amino acid sequence selected from:

ments, $X_{38}$ is selected from A, T, D or E, or modified form thereof. In specific embodiments, Σ is selected from S, T or A, or modified form thereof.

In some embodiments, B of formula XI is selected from R or K, or modified form thereof, and Ω of formula XI is selected from A, S, T or E, or modified form thereof.

In some embodiments, the polypeptides further comprise upstream (e.g., immediately upstream) of the sequence represented by formula X an amino acid sequence represented by formula IX:

$$X_{54}X_{55}X_{56}X_{57}X_{58}RGO_1X_{59} \qquad (IX)$$

wherein:

$X_{54}$ is absent or is selected from acidic amino acid residues (e.g., D or E, or modified form thereof) or neutral/polar amino acid residues (e.g., N, or modified form thereof), wherein $X_{54}$ is present in some embodiments with the proviso that $X_{55}$ is present;

$X_{55}$ is absent or is selected from any amino acid residue (e.g., hydrophobic amino acid residues including aliphatic amino acid residues such as L or V, or modified form thereof; small amino acid residues such as S, T or A, or modified form thereof; or neutral/polar amino acid residues such as N, or modified form thereof), wherein $X_{55}$ is present in some embodiments with the proviso that $X_{56}$ is present;

$X_{56}$ is absent or is selected from acidic amino acid residues (e.g., D or E, or modified form thereof), wherein $X_{56}$ is present in some embodiments with the proviso that $X_{57}$ is present;

```
                                              [SEQ ID NO: 166]
(1) MGVKLIFAVVCVAAAQAATINENFEDIDLVAIGGSFALDVDANRGGHGGHPGKKM
PKEVLVEMEANAKRAGCHRGCLICLSHIKCTKKMKKFIPGRCHSYEGDKDSAQGGIGEEIVD
MPEIPGFKDKEPMDQFIAQVDLCVDCTTGCLKGLANVHCSDLLKKWLPSRCKTFASKIQSQV
DTIKGLAGDR
```
(full-length *Metridia pacifica* 2bv1 luciferase);

```
                                              [SEQ ID NO: 168]
(2) MGVKLIFAVVCVAAAQAATINENFEDIDLVAIGGSFALDVDANRGGHGGHPGKKM
PKEVPVEMEANAKRAGCHRGCLICLSHIKCTKKMKKFIPGRCHSYEGDKDSAQGGIGEEIVD
MPEIPGFKDKEPMDQFIAQVDLCVDCTTGCLKGLANVHCSDLLKKWLPSRCKTFASKIQSQV
DTIKGLAGDR
```
(full-length *Metridia pacifica* 2bv2 luciferase);
and

```
                                              [SEQ ID NO: 170]
(3) MGVKLIFAVVCVAVAQAATIQENFEDIDLVAIGGSFASDVDANRGGHGGHPGKKM
PKEVLMEMEANAKRAGCHRGCLVCLSHIKCTAQMQKFIPGRCHSYAGDKDSAQGGIAGGAI
VDIPEIAGFKEMKPMEQFIAQVDLCEDCTTGCLKGLANVHCSDLLKKWLPSRCKTFASKIQSQ
VDTIKGLAGDR
```
(full-length *Metridia longa 22* luciferase);

```
                                              [SEQ ID NO: 172]
(4) MDIKVLFALICIALVQANPTENNDHINIVGIEGKFGITDLETDLFTIWETNRMISTDNE
QANTDSNRGKMPGKKLPLAVLIEMEANAFKAGCTRGCLICLSKIKCTAKMKKYIPGRCHDYG
GDKKTGQAGIVGAIVDIPDISGFKEMGPMEQFIAQVDRCTDCTTGCLKGLANVKCSELLKKW
LPDRCASFADKIQSEVHNIKGLAGDR
```
(full-length *Metridia longa* 39 luciferase).

In some embodiments, at least two subsequences selected from $B_1C_5X_{18}X_{19}$, $X_{37}C_6X_{38}X_{39}$ or $X_{41}C_9\Sigma X_{42}$ each consist of an amino acid sequence represented by formula XI. In other embodiments, each subsequence selected from $B_1C_5X_{18}X_{19}$, $X_{37}C_6X_{38}X_{39}$ or $X_{41}C_9\Sigma X_{42}$ consists of an amino acid sequence represented by formula XI.

In some embodiments, B of formula XI is selected from R or K, or modified form thereof.

In some embodiments, Ω of formula XI is selected from A, S, T or E, or modified form thereof. In specific embodiments, $X_{18}$ is A or modified form thereof. In specific embodi- $X_{57}$ is absent or is selected from any amino acid residue (e.g., hydrophobic amino acid residue including aliphatic amino acid residues such as V, or modified form thereof; or small amino acid residues such as S, T or A, or modified form thereof), wherein $X_{57}$ is present in some embodiments with the proviso that $X_{58}$ is present;

$X_{58}$ is selected from acidic amino acid residues (e.g., D or E, or modified form thereof) or neutral/polar amino acid residues (e.g., N, or modified form thereof), wherein $X_{58}$ is present in some embodiments with the proviso that $O_1$ is present;

$O_1$ is absent or is the sequence $J_1J_2J_3$, wherein $J_1$ is selected from small amino acid residues (e.g., G or modified form thereof), $J_2$ is selected from basic amino acid residues (e.g., H or modified form thereof), and $J_3$ is selected from small amino acid residues (e.g., G or modified form thereof), wherein $O_1$ is present in some embodiments with the proviso that $X_{59}$ is present; and $X_{59}$ is selected from basic amino acid residues (e.g., K, or modified form thereof); or small amino acid residues (e.g., G or modified form thereof).

In some embodiments, the polypeptides comprise, consist or consist essentially of an amino acid sequence represented by formula XII:

$$Z_1\text{-}\Pi\text{-}Z_2 \quad \text{(XII)}$$

wherein:

Π is selected from the amino acid sequence represented by formula X or an amino acid sequence that shares at least 70% (and at least 71% to at least 99% and all integer percentages in between) sequence similarity or sequence identity with the amino acid sequence represented by formula X;

$Z_1$ is absent or is selected from at least one of a proteinaceous moiety comprising from about 1 to about 80 amino acid residues (and all integer residues in between), an amino acid residue for initiation of protein synthesis in vivo (e.g., M or modified form thereof), and a protecting moiety (e.g., an N-terminal blocking residue such as pyroglutamate); and $Z_2$ is absent or is a proteinaceous moiety comprising from about 1 to about 50 amino acid residues (and all integer residues in between).

Suitably, $Z_1$ comprises, consists or consists essentially of a signal peptide for secreting the polypeptide to an extracellular location. In some embodiments, the signal peptide comprises an amino acid sequence represented by formula IV as broadly defined above. Representative signal peptides comprise, consist or consist essentially of an amino acid sequence selected from the group consisting of:

(a) an amino acid sequence selected from SEQ ID NO: 84, 86, 88, 90, 92, 94, 96, 98, 100, 102 or 104;

(b) an amino acid sequence that shares at least 70% (and at least 71% to at least 99% and all integer percentages in between) sequence similarity or sequence identity with the sequence set forth in any one of SEQ ID NO: 84, 86, 88, 90, 92, 94, 96, 98, 100, 102 or 104;

(c) an amino acid sequence which is encoded by the nucleotide sequence set forth in any one of SEQ ID NO: 83, 85, 87, 89, 91, 93, 95, 97, 99, 101 or 103;

(d) an amino acid sequence which is encoded by a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof; or (e) an amino acid sequence which is encoded by a nucleotide sequence that hybridizes under at least medium or high stringency conditions to the sequence set forth in any one of SEQ ID NO: 83, 85, 87, 89, 91, 93, 95, 97, 99, 101 or 103, or a complement thereof.

In some embodiments, $Z_1$ comprises, consists or consists essentially of a secretion-enhancing sequence, non-limiting examples of which are selected from:

(a) an amino acid sequence as set forth in any one of SEQ ID NO: 106, 107, 108, 110, 112, 114, 116, 118, 120, 122, 124, 126, 128, 130 or 132; or;

(b) an amino acid sequence that shares at least 70% (and at least 71% to at least 99% and all integer percentages in between) sequence similarity or sequence identity with the sequence set forth in any one of SEQ ID NO: 106, 107, 108, 110, 112, 114, 116, 118, 120, 122, 124, 126, 128, 130 or 132;

(c) an amino acid sequence which is encoded by a nucleotide sequence set forth in any one of SEQ ID NO: 105, 107, 109, 111, 113, 115, 117, 119, 121, 123, 125, 127, 129 or 131, or a complement thereof;

(d) an amino acid sequence which is encoded by a nucleotide sequence that shares at least 70% (and at least 71% to at least 99% and all integer percentages in between) sequence identity with the sequence set forth in any one of SEQ ID NO: 105, 107, 109, 111, 113, 115, 117, 119, 121, 123, 125, 127, 129 or 131, or a complement thereof; or (e) an amino acid sequence which is encoded by a nucleotide sequence that hybridizes under at least medium or high stringency conditions to the sequence set forth in any one of SEQ ID NO: 105, 107, 109, 111, 113, 115, 117, 119, 121, 123, 125, 127, 129 or 131, or a complement thereof.

In some embodiments, the polypeptides according to formula X comprise, consist or consist essentially of an amino acid sequence selected from the group consisting of:

(a) an amino acid sequence selected from:

[SEQ ID NO: 174]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDLCVDCTTGCLKGLANVQCSDLLKKWLPQRCATFASKIQGQV
DKIKGAGGD
(full-length sequence of *Gaussia princeps* Prolume luciferase with RCAD substitution at $C_5$);

[SEQ ID NO: 176]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDLCVDCTTGCLKGLANVQCSDLLKKWLPQRCATFASKIQGQV
DKIKGAGGDKDEL
(full-length sequence of *Gaussia princeps* Prolume KDEL luciferase with RCAD substitution at $C_5$);

[SEQ ID NO: 178]
MGVKVLFALICIAVAEAKPTENNEDFNIVAVASNFATTDLDADRGKLPGK
KLPLEVLKEIEANARKAGCTRGCLICLSHIKCTPKMKKFIPGRCADYEGDKESAQGGIGEAIV
DIPEIPGFKDLEPMEQFIAQVDLCVDCTTGCLKGLANVQCSDLLKKWLPQRCATFASKIQGQV
DKIKGAGGD
(full-length sequence of *Gaussia princeps* Mutant 1 luciferase with RCAD substitution at $C_5$);

-continued

[SEQ ID NO: 180]
MGVKVLFALICIAVAEAKPTENNEDFNIVAVASNFATTDLDADRGKLPGK
KLPLEVLKELEANARKAGCTRGCLICLSHIKCTPKMKKFIPGRCADYEGDKESAQGGIGEAIV
DIPEIPGFKDLEPLEQFIAQVDLCVDCTTGCLKGLANVQCSDLLKKWLPQRCATFASKIQGQV
DKIKGAGGD
(full-length sequence of *Gaussia princeps* Mutant 2 luciferase with RCAD substitution at $C_5$);

[SEQ ID NO: 182]
MEAKPTENNEDFNIVAVASNFATTDLDADRGKLPGKKLPLEVLKEMEANA
RKAGCTRGCLICLSHIKCTPKMKKFIPGRCADYEGDKESAQGGIGEAIVDIPEIPGFKDLEPME
QFIAQVDLCVDCTTGCLKGLANVQCSDLLKKWLPQRCATFASKIQGQVDKIKGAGGD
(full-length sequence of *Gaussia princeps* GS luciferase with RCAD substitution at $C_5$);

[SEQ ID NO: 184]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVHCSALLKKWLPSRCKTFAS
KIQSQVDTIKGLAGDR
(full-length *Metridia pacifica* 2a luciferase with RCAD substitution at $C_5$);

[SEQ ID NO: 186]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVHCSDLLKKWLPSRCKTFAS
KIQSQVDTIKGLAGDR
(full-length *Metridia pacifica* 2bv1 luciferase with RCAD substitution at $C_5$);

[SEQ ID NO: 188]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVHCSDLLKKWLPSRCKTFAS
KIQSQVDTIKGLAGDR
(full-length *Metridia pacifica* 2bv2 luciferase with RCAD substitution at $C_5$);

[SEQ ID NO: 190]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCADYAGDKDSAQGG
IAGGAIVDIPEIAGFKEMKPMEQFIAQVDLCEDCTTGCLKGLANVHCSDLLKKWLPSRCKTFA
SKIQSQVDTIKGLAGDR
(full-length *Metridia longa* 22 luciferase with RCAD substitution at $C_5$);

[SEQ ID NO: 192]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(full-length *Metridia pacifica* 1v1 luciferase with RCAD substitution at $C_5$);

[SEQ ID NO: 194]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(full-length *Metridia pacifica* 1v2 luciferase with RCAD substitution at $C_5$);

[SEQ ID NO: 196]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(full-length *Metridia pacifica* 1v3 luciferase with RCAD substitution at $C_5$);

[SEQ ID NO: 198]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CADYGGDKKTGQAGIVGAIVDIPDISGFKEMGPMEQFIAQVDRCTDCTTGCLKGLANVKCSE
LLKKWLPDRCASFADKIQSEVHNIKGLAGDR
(full-length *Metridia longa* 39 luciferase with RCAD substitution at $C_5$);

-continued

[SEQ ID NO: 200]
MDIKFIFALVCIALVQANPTVNNDVNRGKMPGKKLPLEVLIEMEANAFKA
GCTRGCLICLSKIKCTAKMKQYIPGRCADYGGDKKTGQAGIVGAIVDIPEISGFKEMEPMEQFI
AQVDLCADCTTGCLKGLANVKCSELLKKWLPDRCASFADKIQKEAHNIKGLAGDR
(full-length *Metridia longa* 7 luciferase with RCAD substitution at $C_5$);

[SEQ ID NO: 202]
MKTDIADTDRASNFVATETDANRGKMPGKKLPLAVIMEMEANAFKAGCT
RGCLICLSKIKCTAKMKVYIPGRCADYGGDKKTGQAGIVGAIVDIPEISGFKEMAPMEQFIAQ
VDRCASCTTGCLKGLANVKCSELLKKWLPDRCASFADKIQKEVHNIKGMAGDR
(full-length *Metridia longa* GS luciferase with RCAD substitution at $C_5$);

[SEQ ID NO: 204]
MDIKVVFTLVFSALVQAQKTDIADTDRASNFVATETDANRGKMPGKKLPL
AVIMEMEANAFKAGCTRGCLICLSKIKCTAKMKVYIPGRCADYGGDKKTGQAGIVGAIVDIP
EISGFKEMAPMEQFIAQVDRCASCTTGCLKGLANVKCSELLKKWLPDRCASFADKIQKEVHN
IKGMAGDR
(full-length *Metridia longa* 164M3 luciferase with RCAD substitution at $C_5$);

[SEQ ID NO: 206]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVDRCASCTTG
CLKGLANVKCSELLKKWLPDRCASFADKIQKEVHNIKGMAGDR
(full-length *Metridia longa* 164v1 luciferase with RCAD substitution at $C_5$);

[SEQ ID NO: 208]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVERCASCTTG
CLKGLANVKCSELLKKWLPDRCASFADKIQKEVHNIKGMAGDR
(full-length *Metridia longa* 164v2 luciferase with RCAD substitution at $C_5$);

[SEQ ID NO: 210]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCTSCTTGCL
KGLANVKCSELLKKWLPDRCASFADKIQKEVHNIKGMAGDR
(full-length *Metridia longa* 16 luciferase with RCAD substitution at $C_5$);

[SEQ ID NO: 212]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCADYGGDKKTGQAGIVGAIVDIPEISGFKEMEPMEQFIAQVDRCASCTTGCL
KGLANVKCSELLKKWLPDRCASFADKIQKEVHNIKGMAGDR
(full-length *Metridia longa* 45 luciferase with RCAD substitution at $C_5$);

[SEQ ID NO: 214]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCADYGGDKKTGQAGIVGAIVDIPEISGFKEMEPMEQFIAQVDRCASCNTG
CLKGLANVKCSELLKKWLPDRCASFADKIQKEVHNIKGMAGDR
(full-length *Metridia longa* 52 luciferase with RCAD substitution at $C_5$); and

[SEQ ID NO: 216]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDLCATCTTGCL
KGLANVKCSELLKKWLPGRCASFADKIQKEVHNIKGMAGDR
(full-length *Metridia longa* AL luciferase with RCAD substitution at $C_5$);

[SEQ ID NO: 218]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDRCADCTTGCLKGLANVQCSDLLKKWLPQRCATFASKIQGQV
DKIKGAGGD
(full-length sequence of *Gaussia princeps* Prolume luciferase with RCAD substitution at $C_6$);

-continued

[SEQ ID NO: 220]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDRCADCTTGCLKGLANVQCSDLLKKWLPQRCATFASKIQGQV
DKIKGAGGDKDEL
(full-length sequence of *Gaussia princeps* Prolume KDEL luciferase with RCAD substitution at $C_6$);

[SEQ ID NO: 222]
MGVKVLFALICIAVAEAKPTENNEDFNIVAVASNFATTDLDADRGKLPGK
KLPLEVLKEIEANARKAGCTRGCLICLSHIKCTPKMKKFIPGRCHTYEGDKESAQGGIGEAIVD
IPEIPGFKDLEPMEQFIAQVDRCADCTTGCLKGLANVQCSDLLKKWLPQRCATFASKIQGQVD
KIKGAGGD
(full-length sequence of *Gaussia princeps* Mutant 1 luciferase with RCAD substitution at $C_6$);

[SEQ ID NO: 224]
MGVKVLFALICIAVAEAKPTENNEDFNIVAVASNFATTDLDADRGKLPGK
KLPLEVLKELEANARKAGCTRGCLICLSHIKCTPKMKKFIPGRCHTYEGDKESAQGGIGEAIV
DIPEIPGFKDLEPLEQFIAQVDRCADCTTGCLKGLANVQCSDLLKKWLPQRCATFASKIQGQV
DKIKGAGGD
(full-length sequence of *Gaussia princeps* Mutant 2 luciferase with RCAD substitution at $C_6$);

[SEQ ID NO: 226]
MEAKPTENNEDFNIVAVASNFATTDLDADRGKLPGKKLPLEVLKEMEANA
RKAGCTRGCLICLSHIKCTPKMKKFIPGRCHTYEGDKESAQGGIGEAIVDIPEIPGFKDLEPME
QFIAQVDRCADCTTGCLKGLANVQCSDLLKKWLPQRCATFASKIQGQVDKIKGAGGD
(full-length sequence of *Gaussia princeps* GS luciferase with RCAD substitution at $C_6$)

[SEQ ID NO: 228]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVHCSALLKKWLPSRCKTFASKI
QSQVDTIKGLAGDR
(full-length *Metridia pacifica* 2a luciferase with RCAD substitution at $C_6$);

[SEQ ID NO: 230]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVHCSDLLKKWLPSRCKTFASKI
QSQVDTIKGLAGDR
(full-length *Metridia pacifica* 2bv1 luciferase with RCAD substitution at $C_6$);

[SEQ ID NO: 232]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVHCSDLLKKWLPSRCKTFASKI
QSQVDTIKGLAGDR
(full-length *Metridia pacifica* 2bv2 luciferase with RCAD substitution at $C_6$);

[SEQ ID NO: 234]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCHSYAGDKDSAQGGI
AGGAIVDIPEIAGFKEMKPMEQFIAQVDRCADCTTGCLKGLANVHCSDLLKKWLPSRCKTFA
SKIQSQVDTIKGLAGDR
(full-length *Metridia longa* 22 luciferase with RCAD substitution at $C_6$);

[SEQ ID NO: 236]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia pacifica* 1v1 luciferase with RCAD substitution at $C_6$);

[SEQ ID NO: 238]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia pacifica* 1v2 luciferase with RCAD substitution at $C_6$);

-continued

[SEQ ID NO: 240]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia pacifica* 1v3 luciferase with RCAD substitution at $C_6$);

[SEQ ID NO: 242]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CHDYGGDKKTGQAGIVGAIVDIPDISGFKEMGPMEQFIAQVDRCADCTTGCLKGLANVKCSE
LLKKWLPDRCASFADKIQSEVHNIKGLAGDR
(full-length *Metridia longa* 39 luciferase with RCAD substitution at $C_6$);

[SEQ ID NO: 244]
MDIKFIFALVCIALVQANPTVNNDVNRGKMPGKKLPLEVLIEMEANAFKA
GCTRGCLICLSKIKCTAKMKQYIPGRCHDYGGDKKTGQAGIVGAIVDIPEISGFKEMEPMEQFI
AQVDRCADCTTGCLKGLANVKCSELLKKWLPDRCASFADKIQKEAHNIKGLAGDR
(full-length *Metridia longa* 7 luciferase with RCAD substitution at $C_6$);

[SEQ ID NO: 246]
MKTDIADTDRASNFVATETDANRGKMPGKKLPLAVIMEMEANAFKAGCT
RGCLICLSKIKCTAKMKVYIPGRCHDYGGDKKTGQAGIVGAIVDIPEISGFKEMAPMEQFIAQ
VDRCADCTTGCLKGLANVKCSELLKKWLPDRCASFADKIQKEVHNIKGMAGDR
(full-length *Metridia longa* GS luciferase with RCAD substitution at $C_6$);

[SEQ ID NO: 248]
MDIKVVFTLVFSALVQAQKTDIADTDRASNFVATETDANRGKMPGKKLPL
AVIMEMEANAFKAGCTRGCLICLSKIKCTAKMKVYIPGRCHDYGGDKKTGQAGIVGAIVDIP
EISGFKEMAPMEQFIAQVDRCADCTTGCLKGLANVKCSELLKKWLPDRCASFADKIQKEVHN
IKGMAGDR
(full-length *Metridia longa* 164M3 luciferase with RCAD substitution at $C_6$);

[SEQ ID NO: 250]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVDRCADCTTG
CLKGLANVKCSELLKKWLPDRCASFADKIQKEVHNIKGMAGDR
(full-length *Metridia longa* 164v1 luciferase with RCAD substitution at $C_6$);

[SEQ ID NO: 252]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVERCADCTTG
CLKGLANVKCSELLKKWLPDRCASFADKIQKEVHNIKGMAGDR
(full-length *Metridia longa* 164v2 luciferase with RCAD substitution at $C_6$);

[SEQ ID NO: 254]
MDMKVIFALIFSALVQAKSTEFDPNIDEVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCADCTTGCL
KGLANVKCSELLKKWLPDRCASFADKIQKEVHNIKGMAGDR
(full-length *Metridia longa* 16 luciferase with RCAD substitution at $C_6$);

[SEQ ID NO: 256]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCHDYGGDKKTGQAGIVGAIVDIPEISGFKEMEPMEQFIAQVDRCADCTTGCL
KGLANVKCSELLKKWLPDRCASFADKIQKEVHNIKGMAGDR
(full-length *Metridia longa* 45 luciferase with RCAD substitution at $C_6$);

[SEQ ID NO: 258]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCHDYGGDKKTGQAGIVGAIVDIPEISGFKEMEPMEQFIAQVDRCADCNTG
CLKGLANVKCSELLKKWLPDRCASFADKIQKEVHNIKGMAGDR
(full-length *Metridia longa* 52 luciferase with RCAD substitution at $C_6$);

-continued

[SEQ ID NO: 260]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCADCTTGCL
KGLANVKCSELLKKWLPGRCASFADKIQKEVHNIKGMAGDR
(full-length
*Metridia longa* AL luciferase with RCAD substitution at $C_6$);

[SEQ ID NO: 262]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDLCVDCTTGCLKGLANVKCSDLLKKWLPQRCATFASKIQGQV
DKIKGAGGD
(full-length sequence of *Gaussia princeps* Prolume luciferase with
KCSD substitution at $C_9$);

[SEQ ID NO: 264]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDLCVDCTTGCLKGLANVKCSDLLKKWLPQRCATFASKIQGQV
DKIKGAGGDKDEL
(full-length sequence of *Gaussia princeps* Prolume KDEL
luciferase with KCSD substitution at $C_9$);

[SEQ ID NO: 266]
MGVKVLFALICIAVAEAKPTENNEDFNIVAVASNFATTDLDADRGKLPGK
KLPLEVLKEIEANARKAGCTRGCLICLSHIKCTPKMKKFIPGRCHTYEGDKESAQGGIGEAIVD
IPEIPGFKDLEPMEQFIAQVDLCVDCTTGCLKGLANVKCSDLLKKWLPQRCATFASKIQGQVD
KIKGAGGD
(full-length sequence of *Gaussia princeps* Mutant 1 luciferase with
KCSD substitution at $C_9$);

[SEQ ID NO: 268]
MGVKVLFALICIAVAEAKPTENNEDFNIVAVASNFATTDLDADRGKLPGK
KLPLEVLKELEANARKAGCTRGCLICLSHIKCTPKMKKFIPGRCHTYEGDKESAQGGIGEAIV
DIPEIPGFKDLEPLEQFIAQVDLCVDCTTGCLKGLANVKCSDLLKKWLPQRCATFASKIQGQV
DKIKGAGGD
(full-length sequence of *Gaussia princeps* Mutant 2 luciferase with
KCSD substitution at $C_9$);

[SEQ ID NO: 270]
MEAKPTENNEDFNIVAVASNFATTDLDADRGKLPGKKLPLEVLKEMEANA
RKAGCTRGCLICLSHIKCTPKMKKFIPGRCHTYEGDKESAQGGIGEAIVDIPEIPGFKDLEPME
QFIAQVDLCVDCTTGCLKGLANVKCSDLLKKWLPQRCATFASKIQGQVDKIKGAGGD
(full-length sequence of *Gaussia princeps* GS luciferase with
KCSD substitution at $C_9$)

[SEQ ID NO: 272]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVKCSDLLKKWLPSRCKTFASKI
QSQVDTIKGLAGDR
(full-length *Metridia pacifica* 2a luciferase with KCSD
substitution at $C_9$);

[SEQ ID NO: 274]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVKCSDLLKKWLPSRCKTFASKI
QSQVDTIKGLAGDR
(full-length *Metridia pacifica* 2bv1 luciferase with KCSD
substitution at $C_9$);

[SEQ ID NO: 276]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVKCSDLLKKWLPSRCKTFASKI
QSQVDTIKGLAGDR
(full-length *Metridia pacifica* 2bv2 luciferase with KCSD
substitution at $C_9$);

[SEQ ID NO: 278]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCHSYAGDKDSAQGGI
AGGAIVDIPEIAGFKEMKPMEQFIAQVDLCEDCTTGCLKGLANVKCSDLLKKWLPSRCKTFA
SKIQSQVDTIKGLAGDR
(full-length *Metridia longa* 22 luciferase with KCSD
substitution at $C_9$);

-continued

[SEQ ID NO: 280]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v1 luciferase with KCSD substitution at $C_9$);

[SEQ ID NO: 282]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v2 luciferase with KCSD substitution at $C_9$);

[SEQ ID NO: 284]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v3 luciferase with KCSD substitution at $C_9$);

[SEQ ID NO: 286]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CHDYGGDKKTGQAGIVGAIVDIPDISGFKEMGPMEQFIAQVDRCTDCTTGCLKGLANVKCSD
LLKKWLPDRCASFADKIQSEVHNIKGLAGDR
(full-length *Metridia longa* 39 luciferase with KCSD substitution at $C_9$);

[SEQ ID NO: 288]
MDIKFIFALVCIALVQANPTVNNDVNRGKMPGKKLPLEVLIEMEANAFKA
GCTRGCLICLSKIKCTAKMKQYIPGRCHDYGGDKKTGQAGIVGAIVDIPEISGFKEMEPMEQFI
AQVDLCADCTTGCLKGLANVKCSDLLKKWLPDRCASFADKIQKEAHNIKGLAGDR
(full-length *Metridia longa* 7 luciferase with KCSD substitution at $C_9$);

[SEQ ID NO: 290]
MKTDIADTDRASNFVATETDANRGKMPGKKLPLAVIMEMEANAFKAGCT
RGCLICLSKIKCTAKMKVYIPGRCHDYGGDKKTGQAGIVGAIVDIPEISGFKEMAPMEQFIAQ
VDRCASCTTGCLKGLANVKCSDLLKKWLPDRCASFADKIQKEVHNIKGMAGDR
(full-length *Metridia longa* GS luciferase with KCSD substitution at $C_9$);

[SEQ ID NO: 292]
MDIKVVFTLVFSALVQAQKTDIADTDRASNFVATETDANRGKMPGKKLPL
AVIMEMEANAFKAGCTRGCLICLSKIKCTAKMKVYIPGRCHDYGGDKKTGQAGIVGAIVDIP
EISGFKEMAPMEQFIAQVDRCASCTTGCLKGLANVKCSDLLKKWLPDRCASFADKIQKEVHN
IKGMAGDR
(full-length *Metridia longa* 164M3 luciferase with KCSD substitution at $C_9$);

[SEQ ID NO: 294]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVDRCASCTTG
CLKGLANVKCSDLLKKWLPDRCASFADKIQKEVHNIKGMAGDR
(full-length *Metridia longa* 164v1 luciferase with KCSD substitution at $C_9$);

[SEQ ID NO: 296]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVERCASCTTGC
LKGLANVKCSDLLKKWLPDRCASFADKIQKEVHNIKGMAGDR
(full-length *Metridia longa* 164v2 luciferase with KCSD substitution at $C_9$);

[SEQ ID NO: 298]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCTSCTTGCL
KGLANVKCSDLLKKWLPDRCASFADKIQKEVHNIKGMAGDR
(full-length *Metridia longa* 16 luciferase with KCSD substitution at $C_9$);

-continued

[SEQ ID NO: 300]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCHDYGGDKKTGQAGIVGAIVDIPEISGFKEMEPMEQFIAQVDRCASCTTGCL
KGLANVKCSDLLKKWLPDRCASFADKIQKEVHNIKGMAGDR
(full-length
*Metridia longa* 45 luciferase with KCSD substitution at $C_9$);

[SEQ ID NO: 302]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCHDYGGDKKTGQAGIVGAIVDIPEISGFKEMEPMEQFIAQVDRCASCNTG
CLKGLANVKCSDLLKKWLPDRCASFADKIQKEVHNIKGMAGDR
(full-
length *Metridia longa* 52 luciferase with KCSD substitution at $C_9$);

[SEQ ID NO: 304]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDLCATCTTGCL
KGLANVKCSDLLKKWLPGRCASFADKIQKEVHNIKGMAGDR
(full-length
*Metridia longa* AL luciferase with KCSD substitution at $C_9$);

[SEQ ID NO: 306]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDRCADCTTGCLKGLANVQCSDLLKKWLPQRCATFASKIQGQV
DKIKGAGGD
(full-length sequence of *Gaussia princeps* Prolume luciferase with
RCAD substitution at $C_5$ and at $C_6$);

[SEQ ID NO: 308]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDRCADCTTGCLKGLANVQCSDLLKKWLPQRCATFASKIQGQV
DKIKGAGGDKDEL
(full-length sequence of *Gaussia princeps* Prolume KDEL
luciferase with RCAD substitution at $C_5$ and at $C_6$);

[SEQ ID NO: 310]
MGVKVLFALICIAVAEAKPTENNEDFNIVAVASNFATTDLDADRGKLPGK
KLPLEVLKEIEANARKAGCTRGCLICLSHIKCTPKMKKFIPGRCADYEGDKESAQGGIGEAIV
DIPEIPGFKDLEPMEQFIAQVDRCADCTTGCLKGLANVQCSDLLKKWLPQRCATFASKIQGQV
DKIKGAGGD
(full-length sequence of *Gaussia princeps* Mutant 1 luciferase with
RCAD substitution at $C_5$ and at $C_6$);

[SEQ ID NO: 312]
MGVKVLFALICIAVAEAKPTENNEDFNIVAVASNFATTDLDADRGKLPGK
KLPLEVLKELEANARKAGCTRGCLICLSHIKCTPKMKKFIPGRCADYEGDKESAQGGIGEAIV
DIPEIPGFKDLEPLEQFIAQVDRCADCTTGCLKGLANVQCSDLLKKWLPQRCATFASKIQGQV
DKIKGAGGD
(full-length sequence of *Gaussia princeps* Mutant 2 luciferase with
RCAD substitution at $C_5$);

[SEQ ID NO: 314]
MEAKPTENNEDFNIVAVASNFATTDLDADRGKLPGKKLPLEVLKEMEANA
RKAGCTRGCLICLSHIKCTPKMKKFIPGRCADYEGDKESAQGGIGEAIVDIPEIPGFKDLEPME
QFIAQVDRCADCTTGCLKGLANVQCSDLLKKWLPQRCATFASKIQGQVDKIKGAGGD
(full-length sequence of *Gaussia princeps* GS luciferase with
RCAD substitution at $C_5$ and at $C_6$);

[SEQ ID NO: 316]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVHCSALLKKWLPSRCKTFAS
KIQSQVDTIKGLAGDR
(full-length *Metridia pacifica* 2a luciferase with RCAD
substitution at $C_5$ and at $C_6$);

[SEQ ID NO: 318]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVHCSDLLKK WLPSRCKTFAS
KIQSQVDTIKGLAGDR
(full-length *Metridia pacifica* 2bv1 luciferase with
RCAD substitution at $C_5$ and at $C_6$);

-continued

[SEQ ID NO: 320]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVHCSDLLKKWLPSRCKTFAS
KIQSQVDTIKGLAGDR
(full-length *Metridia pacifica* 2bv2 luciferase with
RCAD substitution at $C_5$ and at $C_6$);

[SEQ ID NO: 322]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCADYAGDKDSAQGG
IAGGAIVDIPEIAGFKEMKPMEQFIAQVDRCADCTTGCLKGLANVHCSDLLKKWLPSRCKTF
ASKIQSQVDTIKGLAGDR
(full-length *Metridia longa* 22 luciferase with RCAD
substitution at $C_5$ and at $C_6$);

[SEQ ID NO: 324]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia*
*pacifica* 1v1 luciferase with RCAD substitution at $C_5$ and at $C_6$);

[SEQ ID NO: 326]
MMEIKVLFALICFALVQANPTENKDDIDIVGVEGKFGTTDLETDLFTIVED
MNVISRDTNLANSDADRGKMPGKKLPLEVLIEMEANARKAGCTRGCLI CLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia*
*pacifica* 1v2 luciferase with RCAD substitution at $C_5$ and at $C_6$);

[SEQ ID NO: 328]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(full-length *Metridia*
*pacifica* 1v3 luciferase with RCAD substitution at $C_5$ and at $C_6$);

[SEQ ID NO: 330]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYLPGR
CADYGGDKKTGQAGIVGAIVDIPDISGFKEMGPMEQFIAQVDRCADCTTGCLKGLANVKCSE
LLKKWLPDRCASFADKIQSEVHNIKGLAGDR
(full-length *Metridia longa* 39
luciferase with RCAD substitution at $C_5$ and at $C_6$);

[SEQ ID NO: 332]
MDIKFIFALVCIALVQANPTVNNDVNRGKMPGKKLPLEVLIEMEANAFKA
GCTRGCLICLSKIKCTAKMKQYIPGRCADYGGDKKTGQAGIVGAIVDIPEISGFKEMEPMEQFI
AQVDRCADCTTGCLKGLANVKCSELLKKWLPDRCASFADKIQKEAHNIKGLAGDR
(full-length *Metridia longa* 7 luciferase with RCAD substitution
at $C_5$ and at $C_6$);

[SEQ ID NO: 334]
MKTDIADTDRASNFVATETDANRGKMPGKKLPLAVIMEMEANAFKAGCT
RGCLICLSKIKCTAKMKVYIPGRCADYGGDKKTGQAGIVGAIVDIPEISGFKEMAPMEQFIAQ
VDRCADCTTGCLKGLANVKCSELLKKWLPDRCASFADKIQKEVHNIKGMAGDR
(full-length *Metridia longa* GS luciferase with RCAD substitution
at $C_5$ and at $C_6$);

[SEQ ID NO: 336]
MDIKVVFTLVFSALVQAQKTDIADTDRASNFVATETDANRGKMPGKKLPL
AVIMEMEANAFKAGCTRGCLICLSKIKCTAKMKVYIPGRCADYGGDKKTGQAGIVGAIVDIP
EISGFKEMAPMEQFIAQVDRCADCTTGCLKGLANVKCSELLKKWLPDRCASFADKIQKEVHN
IKGMAGDR
(full-length *Metridia longa* 164M3 luciferase with RCAD
substitution at $C_5$ and at $C_6$);

[SEQ ID NO: 338]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVDRCADCTTG
CLKGLANVKCSELLKKWLPDRCASFADKIQKEVHNIKGMAGDR
(full-
length *Metridia longa* 164v1 luciferase with RCAD substitution
at $C_5$ and at $C_6$);

-continued

[SEQ ID NO: 340]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVERCADCTTG
CLKGLANVKCSELLKKWLPDRCASFADKIQKEVHNIKGMAGDR
(full-length *Metridia longa* 164v2 luciferase with RCAD substitution at $C_5$ and at $C_6$);

[SEQ ID NO: 342]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCADCTTGCL
KGLANVKCSELLKKWLPDRCASFADKIQKEVHNIKGMAGDR
(full-length *Metridia longa* 16 luciferase with RCAD substitution at $C_5$ and at $C_6$);

[SEQ ID NO: 344]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCADYGGDKKTGQAGIVGAIVDIPEISGFKEMEPMEQFIAQVDRCADCTTGCL
KGLANVKCSELLKKWLPDRCASFADKIQKEVHNIKGMAGDR
(full-length *Metridia longa* 45 luciferase with RCAD substitution at $C_5$ and at $C_6$);

[SEQ ID NO: 346]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCADYGGDKKTGQAGIVGAIVDIPEISGFKEMEPMEQFIAQVDRCADCNTG
CLKGLANVKCSELLKKWLPDRCASFADKIQKEVHNIKGMAGDR
(full-length *Metridia longa* 52 luciferase with RCAD substitution at $C_5$ and at $C_6$);

[SEQ ID NO: 348]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCADCTTGCL
KGLANVKCSELLKKWLPGRCASFADKIQKEVHNIKGMAGDR
(full-length *Metridia longa* AL luciferase with RCAD substitution at $C_5$ and at $C_6$);

[SEQ ID NO: 350]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGG IGEAIV
DIPEIPGFKDLEPMEQFIAQVDLCVDCTTGCLKGLANVKCSDLLKKWLPQRCATFASKIQGQV
DKIKGAGGD
(full-length sequence of *Gaussia princeps* Prolume luciferase with RCAD substitution at $C_5$ and with KCSD substitution at $C_9$);

[SEQ ID NO: 352]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDLCVDCTTGCLKGLANVKCSDLLKKWLPQRCATFASKIQGQV
DKIKGAGGDKDEL
(full-length sequence of *Gaussia princeps* Prolume KDEL luciferase with RCAD substitution at $C_5$ and with KCSD substitution at $C_9$);

[SEQ ID NO: 354]
MGVKVLFALICIAVAEAKPTENNEDFNIVAVASNFATTDLDADRGKLPGK
KLPLEVLKEIEANARKAGCTRGCLICLSHIKCTPKMKKFIPGRCADYEGDKESAQGGIGEAIV
DIPEIPGFKDLEPMEQFIAQVDLCVDCTTGCLKGLANVKCSDLLKKWLPQRCATFASKIQGQV
DKIKGAGGD
(full-length sequence of *Gaussia princeps* Mutant 1 luciferase with RCAD substitution at $C_5$ and with KCSD substitution at $C_9$);

[SEQ ID NO: 356]
MGVKVLFALICIAVAEAKPTENNEDFNIVAVASNFATTDLDADRGKLPGK
KLPLEVLKELEANARKAGCTRGCLICLSHIKCTPKMKKFIPGRCADYEGDKESAQGG IGEAIV
DIPEIPGFKDLEPLEQFIAQVDLCVDCTTGCLKGLANVKCSDLLKKWLPQRCATFASKIQGQV
DKIKGAGGD
(full-length sequence of *Gaussia princeps* Mutant 2 luciferase with RCAD substitution at $C_5$ and with KCSD substitution at $C_9$);

-continued

[SEQ ID NO: 358]
MEAKPTENNEDFNIVAVASNFATTDLDADRGKLPGKKLPLEVLKEMEANA
RKAGCTRGCLICLSHIKCTPKMKKFIPGRCADYEGDKESAQGGIGEAIVDIPEIPGFKDLEPME
QFIAQVDLCVDCTTGCLKGLANVKCSDLLKKWLPQRCATFASKIQGQVDKIKGAGGD
(full-length sequence of *Gaussia princeps* GS luciferase with RCAD substitution at $C_5$ and with KCSD substitution at $C_9$);

[SEQ ID NO: 360]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVKCSDLLKKWLPSRCKTFAS
KIQSQVDTIKGLAGDR
(full-length *Metridia pacifica* 2a luciferase with RCAD substitution at $C_5$ and with KCSD substitution at $C_9$);

[SEQ ID NO: 362]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVKCSDLLKKWLPSRCKTFAS
KIQSQVDTIKGLAGDR
(full-length *Metridia pacifica* 2bv1 luciferase with RCAD substitution at $C_5$ and with KCSD substitution at $C_9$);

[SEQ ID NO: 364]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCADYEGDKDSAQGGI
GEEIVDMPEIPGFKDKEPMDQFIAQVDLCVDCTTGCLKGLANVKCSDLLKKWLPSRCKTFAS
KIQSQVDTIKGLAGDR
(full-length *Metridia pacifica* 2bv2 luciferase with RCAD substitution at $C_5$ and with KCSD substitution at $C_9$);

[SEQ ID NO: 366]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCADYAGDKDSAQGG
IAGGAIVDIPEIAGFKEMKPMEQFIAQVDLCEDCTTGCLKGLANVKCSDLLKKWLPSRCKTFA
SKIQSQVDTIKGLAGDR
(full-length *Metridia longa* 22 luciferase with RCAD substitution at $C_5$ and with KCSD substitution at $C_9$);

[SEQ ID NO: 368]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v1 luciferase with RCAD substitution at$C_5$ and with KCSD substitution at $C_9$);

[SEQ ID NO: 370]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v2 luciferase with RCAD substitution at $C_5$ and with KCSD substitution at $C_9$);

[SEQ ID NO: 372]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(full-length *Metridia pacifica* 1v3 luciferase with RCAD substitution at $C_5$ and with KCSD substitution at $C_9$);

[SEQ ID NO: 374]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CADYGGDKKTGQAGIVGAIVDIPDISGFKEMGPMEQFIAQVDRCTDCTTGCLKGLANVKCSD
LLKKWLPDRCASFADKIQSEVHNIKGLAGDR
(full-length *Metridia longa* 39 luciferase with RCAD substitution at $C_5$ and with KCSD substitution at $C_9$);

[SEQ ID NO: 376]
MDIKFIFALVCIALVQANPTVNNDVNRGKMPGKKLPLEVLIEMEANAFKA
GCTRGCLICLSKIKCTAKMKQYIPGRCADYGGDKKTGQAGIVGAIVDIPEISGFKEMEPMEQFI
AQVDLCADCTTGCLKGLANVKCSDLLKKWLPDRCASFADKIQKEAHNIKGLAGDR
(full-length *Metridia longa* 7 luciferase with RCAD substitution at $C_5$ and with KCSD substitution at $C_9$);

-continued

[SEQ ID NO: 378]
MKTDIADTDRASNFVATETDANRGKMPGKKLPLAVIMEMEANAFKAGCT
RGCLICLSKIKCTAKMKVYIPGRCADYGGDKKTGQAGIVGAIVDIPEISGFKEMAPMEQFIAQ
VDRCASCTTGCLKGLANVKCSDLLKKWLPDRCASFADKIQKEVHNIKGMAGDR
(full-length *Metridia longa* GS luciferase with RCAD substitution at $C_5$ and with KCSD substitution at $C_9$);

[SEQ ID NO: 380]
MDIKVVFTLVFSALVQAQKTDIADTDRASNFVATETDANRGKMPGKKLPL
AVIMEMEANAFKAGCTRGCLICLSKIKCTAKMKVYIPGRCADYGGDKKTGQAGIVGAIVDIP
EISGFKEMAPMEQFIAQVDRCASCTTGCLKGLANVKCSDLLKKWLPDRCASFADKIQKEVHN
IKGMAGDR
(full-length *Metridia longa* 164M3 luciferase with RCAD substitution at $C_5$ and with KCSD substitution at $C_9$);

[SEQ ID NO: 382]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVDRCASCTTG
CLKGLANVKCSDLLKKWLPDRCASFADKIQKEVHNIKGMAGDR
(full-length *Metridia longa* 164v1 luciferase with RCAD substitution at $C_5$ and with KCSD substitution at $C_9$);

[SEQ ID NO: 384]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDEPEISGFKEMAPMEQFIAQVERCASCTTG
CLKGLANVKCSDLLKKWLPDRCASFADKIQKEVHNIKGMAGDR
(full-length *Metridia longa* 164v2 luciferase with RCAD substitution at $C_5$ and with KCSD substitution at $C_9$);

[SEQ ID NO: 386]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCTSCTTGCL
KGLANVKCSDLLKKWLPDRCASFADKIQKEVHNIKGMAGDR
(full-length *Metridia longa* 16 luciferase with RCAD substitution at $C_5$ and with KCSD substitution at $C_9$);

[SEQ ID NO: 388]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCADYGGDKKTGQAGIVGAIVDIPEISGFKEMEPMEQFIAQVDRCASCTTGCL
KGLANVKCSDLLKKWLPDRCASFADKIQKEVHNIKGMAGDR
(full-length *Metridia longa* 45 luciferase with RCAD substitution at $C_5$ and with KCSD substitution at $C_9$);

[SEQ ID NO: 390]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCADYGGDKKTGQAGIVGAIVDIPEISGFKEMEPMEQFIAQVDRCASCNTG
CLKGLANVKCSDLLKKWLPDRCASFADKIQKEVHNIKGMAGDR
(full-length *Metridia longa* 52 luciferase with RCAD substitution at $C_5$ and with KCSD substitution at $C_9$);
and

[SEQ ID NO: 392]
MDMRVIFALVFSSLVQAKSTEFDPNINIVGLEGKFGITNLETDLFTIWETMD
VIKSDITDTDRVSNFVATETDANRGKMPGICKLPLAVIMEMEANAFKAGCTRGCLICLSKIKCT
AKMKVYIPGRCADYGGDKKTGQAGIVGAIVDIPEISGFKEMAPMEQFIAQVDLCATCTTGCL
KGLANVKCSDLLKKWLPGRCASFADKIQKEVHNIKGMAGDR
(full-length *Metridia longa* AL luciferase with RCAD substitution at $C_5$ and with KCSD substitution at $C_9$);

[SEQ ID NO: 394]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDRCADCTTGCLKGLANVKCSDLLICKWLPQRCATFASKIQGQ
VDKIKGAGGD
(full-length sequence of *Gaussia princeps* Prolume luciferase with RCAD substitution at $C_6$ and with KCSD substitution at $C_9$);

-continued

[SEQ ID NO: 396]
MGVKVLFALICIAVAEAKPTENNEDFNIVAVASNFATTDLDADRGKLPGK
KLPLEVLKEMEANARKAGCTRGCLICLSHIKCTPKMKKFIPGRCHTYEGDKESAQGGIGEAIV
DIPEIPGFKDLEPMEQFIAQVDRCADCTTGCLKGLANVKCSDLLKKWLPQRCATFASKIQGQ
VDKIKGAGGDKDEL
(full-length sequence of *Gaussia princeps* Prolume KDEL luciferase with RCAD substitution at $C_6$ and with KCSD substitution at $C_9$);

[SEQ ID NO: 398]
MGVKVLFALICIAVAEAKPTENNEDFNIVAVASNFATTDLDADRGKLPGK
KLPLEVLKEIEANARKAGCTRGCLICLSHIKCTPKMKKFIPGRCHTYEGDKESAQGGIGEAIVD
IPEIPGFKDLEPMEQFIAQVDRCADCTTGCLKGLANVKCSDLLKKWLPQRCATFASKIQGQV
DKIKGAGGD
(full-length sequence of *Gaussia princeps* Mutant 1 luciferase with RCAD substitution at $C_6$ and with KCSD substitution at $C_9$);

[SEQ ID NO: 400]
MGVKVLFALICIAVAEAKPTENNEDFNIVAVASNFATTDLDADRGKLPGK
KLPLEVLKELEANARKAGCTRGCLICLSHIKCTPKMICKFIPGRCHTYEGDKESAQGGIGEAIV
DIPEIPGFKDLEPLEQFIAQVDRCADCTTGCLKGLANVKCSDLLKKWLPQRCATFASKIQGQV
DKIKGAGGD
(full-length sequence of *Gaussia princeps* Mutant 2 luciferase with RCAD substitution at $C_6$ and with KCSD substitution at $C_9$);

[SEQ ID NO: 402]
MEAKPTENNEDFNIVAVASNFATTDLDADRGKLPGKKLPLEVLKEMEANA
RKAGCTRGCLICLSHIKCTPKMKKFIPGRCHTYEGDKESAQGGIGEAIVDIPEIPGFKDLEPME
QFIAQVDRCADCTTGCLKGLANVKCSDLLKKWLPQRCATFASKIQGQVDKIKGAGGD
(full-length sequence of *Gaussia princeps* GS luciferase with RCAD substitution at $C_6$ and with KCSD substitution at $C_9$)

[SEQ ID NO: 404]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVKCSDLLKKWLPSRCKTFASK
IQSQVDTIKGLAGDR
(full-length *Metridia pacifica* 2a luciferase with RCAD substitution at $C_6$ and with KCSD substitution at $C_9$);

[SEQ ID NO: 406]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVKCSDLLKKMLPSRCKTFASK
IQSQVDTIKGLAGDR
(full-length *Metridia pacifica* 2bv1 luciferase with RCAD substitution at $C_6$ and with KCSD substitution at $C_9$);

[SEQ ID NO: 408]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCHSYEGDKDSAQGGIG
EEIVDMPEIPGFKDKEPMDQFIAQVDRCADCTTGCLKGLANVKCSDLLKKWLPSRCKTFASK
IQSQVDTIKGLAGDR
(full-length *Metridia pacifica* 2bv2 luciferase with RCAD substitution at $C_6$ and with KCSD substitution at $C_9$);

[SEQ ID NO: 410]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCHSYAGDKDSAQGGI
AGGAIVDIPEIAGFKEMKPMEQFIAQVDRCADCTTGCLKGLANVKCSDLLKKWLPSRCKTFA
SKIQSQVDTIKGLAGDR
(full-length *Metridia longa* 22 luciferase with RCAD substitution at $C_6$ and with KCSD substitution at $C_9$);

[SEQ ID NO: 412]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v1 luciferase with RCAD substitution at $C_6$ and with KCSD substitution at $C_9$);

[SEQ ID NO: 414]
MMEIKVLFALICFALVQANPTENKDDIDIVGVEGKFGTTDLETDLFTIVED
MNVISRDTNLANSDADRGKMPGKKLPLEVLIEMEANARICAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v2 luciferase with RCAD substitution at $C_6$ and with KCSD substitution at $C_9$);

-continued

[SEQ ID NO: 416]
MMEVKVVFALICFALVQANPTENKDDIDIVGVEGKFGTTDLETDLFTIVED
MNVISRDTNLANSDADRGKMPGICKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v3 luciferase with RCAD substitution at $C_6$ and with KCSD substitution at $C_9$);

[SEQ ID NO: 418]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CHDYGGDKKTGQAGIVGAIVDIPDISGFKEMGPMEQFIAQVDRCADCTTGCLKGLANVKCS
DLLKKWLPDRCASFADKIQSEVHNIKGLAGDR
(full-length *Metridia longa* 39 luciferase with RCAD substitution at $C_6$ and with KCSD substitution at $C_9$);

[SEQ ID NO: 420]
MDIKFIFALVCIALVQANPTVNNDVNRGKMPGKKLPLEVLIEMEANAFKA
GCTRGCLICLSKIKCTAKMKQYIPGRCHDYGGDKKTGQAGIVGAIVDIPEISGFKEMEPMEQFI
AQVDRCADCTTGCLKGLANVKCSDLLKKWLPDRCASFADKIQKEAHNIKGLAGDR
(full-length *Metridia longa* 7 luciferase with RCAD substitution at $C_6$ and with KCSD substitution at $C_9$);

[SEQ ID NO: 422]
MKTDIADTDRASNFVATETDANRGKMPGKKLPLAVIMEMEANAFKAGCT
RGCLICLSKIKCTAKMKVYIPGRCHDYGGDKKTGQAGIVGAIVDIPEISGFKEMAPMEQFIAQ
VDRCADCTTGCLKGLANVKCSDLLKKWLPDRCASFADKIQKEVHNIKGMAGDR
(full-length *Metridia longa* GS luciferase with RCAD substitution at $C_6$ and with KCSD substitution at $C_9$);

[SEQ ID NO: 424]
MDIKVVFTLVFSALVQAQKTDIADTDRASNFVATETDANRGKMPGKKLPL
AVIMEMEANAFKAGCTRGCLICLSKIKCTAKMKVYIPGRCHDYGGDKKTGQAGIVGAIVDIP
EISGFKEMAPMEQFIAQVDRCADCTTGCLKGLANVKCSDLLKKWLPDRCASFADKIQKEVH
NIKGMAGDR
(full-length *Metridia longa* 164M3 luciferase with RCAD substitution at $C_6$ and with KCSD substitution at $C_9$);

[SEQ ID NO: 426]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVDRCADCTTG
CLKGLANVKCSDLLKKWLPDRCASFADKIQKEVHNIKGMAGDR
(full-length *Metridia longa* 164v1 luciferase with RCAD substitution at $C_6$ and with KCSD substitution at $C_9$);

[SEQ ID NO: 428]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVERCADCTTG
CLKGLANVKCSDLLKKWLPDRCASFADKIQKEVHNIKGMAGDR
(full-length *Metridia longa* 164v2 luciferase with RCAD substitution at $C_6$ and with KCSD substitution at $C_9$);

[SEQ ID NO: 430]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCADCTTGCL
KGLANVKCSDLLKKWLPDRCASFADKIQKEVHNIKGMAGDR
(full-length *Metridia longa* 16 luciferase with RCAD substitution at $C_6$ and with KCSD substitution at $C_9$);

[SEQ ID NO: 432]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCHDYGGDKKTGQAGIVGAIVDIPEISGFKEMEPMEQFIAQVDRCADCTTGCL
KGLANVKCSDLLKKWLPDRCASFADKIQKEVHNIKGMAGDR
(full-length *Metridia longa* 45 luciferase with RCAD substitution at $C_6$ and with KCSD substitution at $C_9$);

[SEQ ID NO: 434]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCHDYGGDKKTGQAGIVGAIVDIPEISGFKEMEPMEQFIAQVDRCADCNTG
CLKGLANVKCSDLLKKWLPDRCASFADKIQKEVHNIKGMAGDR
(full-length *Metridia longa* 52 luciferase with RCAD substitution at $C_6$ and with KCSD substitution at $C_9$)
;

-continued

[SEQ ID NO: 436]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCADCTTGCL
KGLANVKCSDLLKKWLPGRCASFADKIQKEVHNIKGMAGDR
(full-length *Metridia longa* AL luciferase with RCAD substitution at $C_6$ and with KCSD substitution at $C_9$);

[SEQ ID NO: 438]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDRCADCTTGCLKGLANVKCSDLLKKWLPQRCATFASKIQGQ
VDKIKGAGGD
(full-length sequence of *Gaussia princeps* Prolume luciferase with RCAD substitution at $C_5$ and at $C_6$ and with KCSD substitution at $C_9$);

[SEQ ID NO: 440]
MGVKVLFALICIAVAEAKPTENNEDFNIVAVASNFATTDLDADRGKLPGK
KLPLEVLKEMEANARKAGCTRGCLICLSHIKCTPKMKKFIPGRCADYEGDKESAQGGIGEAIV
DIPEIPGFKDLEPMEQFIAQVDRCADCTTGCLKGLANVKCSDLLKKWLPQRCATFASKIQGQ
VDKIKGAGGDKDEL
(full-length sequence of *Gaussia princeps* Prolume KDEL luciferase with RCAD substitution at $C_5$ and at $C_6$ and with KCSD substitution at $C_9$);

[SEQ ID NO: 442]
MGVKVLFALICIAVAEAKPTENNEDFNIVAVASNFATTDLDADRGKLPGK
KLPLEVLKEIEANARKAGCTRGCLICLSHIKCTPKMKKFIPGRCADYEGDKESAQGGIGEAIV
DIPEIPGFKDLEPMEQFIAQVDRCADCTTGCLKGLANVKCSDLLKKWLPQRCATFASKIQGQ
VDKIKGAGGD
(full-length sequence of *Gaussia princeps* Mutant 1 luciferase with RCAD substitution at $C_5$ and at $C_6$ and with KCSD substitution at $C_9$);

[SEQ ID NO: 444]
MGVKVLFALICIAVAEAKPTENNEDFNIVAVASNFATTDLDADRGKLPGK
KLPLEVLKELEANARKAGCTRGCLICLSHIKCTPKMKKFIPGRCADYEGDKESAQGGIGEAIV
DIPEIPGFKDLEPLEQFIAQVDRCADCTTGCLKGLANVKCSDLLKKWLPQRCATFASKIQGQV
DKIKGAGGD
(full-length sequence of *Gaussia princeps* Mutant 2 luciferase with RCAD substitution at $C_5$ and with KCSD substitution at $C_9$);

[SEQ ID NO: 446]
MEAKPTENNEDFNIVAVASNFATTDLDADRGKLPGKKLPLEVLKEMEANA
RKAGCTRGCLICLSHIKCTPKMKKFIPGRCADYEGDKESAQGGIGEAIVDIPEIPGFKDLEPME
QFIAQVDRCADCTTGCLKGLANVKCSDLLKKWLPQRCATFASKIQGQVDKIKGAGGD
(full-length sequence of *Gaussia princeps* GS luciferase with RCAD substitution at $C_5$ and at $C_6$ and with KCSD substitution at $C_9$);

[SEQ ID NO: 448]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVKCSDLLKKWLPSRCKTFAS
KIQSQVDTIKGLAGDR
(full-length *Metridia pacifica* 2a luciferase with RCAD substitution at $C_5$ and at $C_6$ and with KCSD substitution at $C_9$);

[SEQ ID NO: 450]
MGVKLIFAVVCVAAAQAATINENFEDIDLVAIGGSFALDVDANRGGHGGH
PGKKMPKEVLVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVKCSDLLKKWLPSRCKTFAS
KIQSQVDTIKGLAGDR
(full-length *Metridia pacifica* 2bv1 luciferase with RCAD substitution at $C_5$ and at $C_6$ and with KCSD substitution at $C_9$);

[SEQ ID NO: 452]
MGVKLIFAVVCVAAAQAATINENFEDIDLVAIGGSFALDVDANRGGHGGH
PGKKMPKEVPVEMEANAKRAGCHRGCLICLSHIKCTKKMKKFIPGRCADYEGDKDSAQGGI
GEEIVDMPEIPGFKDKEPMDQFIAQVDRCADCTTGCLKGLANVKCSDLLKKWLPSRCKTFAS
KIQSQVDTIKGLAGDR
(full-length *Metridia pacifica* 2bv2 luciferase with RCAD substitution at $C_5$ and at $C_6$ and with KCSD substitution at $C_9$);

-continued

[SEQ ID NO: 454]
MGVKLIFAVVCVAVAQAATIQENFEDIDLVAIGGSFASDVDANRGGHGGH
PGKKMPKEVLMEMEANAKRAGCHRGCLVCLSHIKCTAQMQKFIPGRCADYAGDKDSAQGG
IAGGAIVDIPEIAGFKEMKPMEQFIAQVDRCADCTTGCLKGLANVKCSDLLKKWLPSRCKTF
ASKIQSQVDTIKGLAGDR
(full-length *Metridia longa* 22 luciferase with RCAD substitution at $C_5$ and at $C_6$ and with KCSD substitution at $C_9$);

[SEQ ID NO: 456]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v1 luciferase with RCAD substitution at $C_5$ and at $C_6$ and with KCSD substitution at $C_9$);

[SEQ ID NO: 458]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v2 luciferase with RCAD substitution at $C_5$ and at $C_6$ and with KCSD substitution at $C_9$);

[SEQ ID NO: 460]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSDLLKKWLPDRCASFADKIQSEVDNIKGLAGDR
(full-length *Metridia pacifica* 1v3 luciferase with RCAD substitution at $C_5$ and at $C_6$ and with KCSD substitution at $C_9$);

[SEQ ID NO: 462]
MDIKVLFALICIALVQANPTENNDHINIVGIEGKFGITDLETDLFTIWETNRM
ISTDNEQANTDSNRGKMPGKKLPLAVLIEMEANAFKAGCTRGCLICLSKIKCTAKMKKYIPGR
CADYGGDKKTGQAGIVGAIVDIPDISGFKEMGPMEQFIAQVDRCADCTTGCLKGLANVKCS
DLLKKWLPDRCASFADKIQSEVHNIKGLAGDR
(full-length *Metridia longa* 39 luciferase with RCAD substitution at $C_5$ and at $C_6$ and with KCSD substitution at $C_9$);

[SEQ ID NO: 464]
MDIKFIFALVCIALVQANPTVNNDVNRGKMPGKKLPLEVLIEMEANAFKA
GCTRGCLICLSKIKCTAKMKQYIPGRCADYGGDKKTGQAGIVGAIVDIPEISGFKEMEPMEQFI
AQVDRCADCTTGCLKGLANVKCSDLLKKWLPDRCASFADKIQKEAHNIKGLAGDR
(full-length *Metridia longa* 7 luciferase with RCAD substitution at $C_5$ and at $C_6$ and with KCSD substitution at $C_9$);

[SEQ ID NO: 466]
MKTDIADTDRASNFVATETDANRGKMPGKKLPLAVIMEMEANAFKAGCT
RGCLICLSKIKCTAKMKVYIPGRCADYGGDKKTGQAGIVGAIVDIPEISGFKEMAPMEQFIAQ
VDRCADCTTGCLKGLANVKCSDLLKKWLPDRCASFADKIQKEVHNIKGMAGDR
(full-length *Metridia longa* GS luciferase with RCAD substitution at $C_5$ and at $C_6$ and with KCSD substitution at $C_9$);

[SEQ ID NO: 468]
MDIKVVFTLVFSALVQAQKTDIADTDRASNFVATETDANRGKMPGKKLPL
AVIMEMEANAFKAGCTRGCLICLSKIKCTAKMKVYIPGRCADYGGDKKTGQAGIVGAIVDIP
EISGFKEMAPMEQFIAQVDRCADCTTGCLKGLANVKCSDLLKKWLPDRCASFADKIQKEVH
NIKGMAGDR
(full-length *Metridia longa* 164M3 luciferase with RCAD substitution at $C_5$ and at $C_6$ and with KCSD substitution at $C_9$);

[SEQ ID NO: 470]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVDRCADCTTG
CLKGLANVKCSDLLKKWLPDRCASFADKIQKEVHNIKGMAGDR
(full-length *Metridia longa* 164v1 luciferase with RCAD substitution at $C_5$ and at $C_6$ and with KCSD substitution at $C_9$);

[SEQ ID NO: 472]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCADYGGDKKTGQAGIVGAIVDIPEISGFKEMAPMEQFIAQVERCADCTTG
CLKGLANVKCSDLLKKWLPDRCASFADKIQKEVHNIKGMAGDR
(full-length *Metridia longa* 164v2 luciferase with RCAD substitution at $C_5$ and at $C_6$ and with KCSD substitution at $C_9$);

-continued

[SEQ ID NO: 474]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCADCTTGCL
KGLANVKCSDLLKKWLPDRCASFADKIQKEVHNIKGMAGDR
(full-length *Metridia longa* 16 luciferase with RCAD
substitution at $C_5$ and at $C_6$ and with KCSD substitution at $C_9$);

[SEQ ID NO: 476]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT
AKMKVYIPGRCADYGGDKKTGQAGIVGAIVDIPEISGFKEMEPMEQFIAQVDRCADCTTGCL
KGLANVKCSDLLKKWLPDRCASFADKIQKEVHNIKGMAGDR
(full-length *Metridia longa* 45 luciferase with RCAD
substitution at $C_5$ and at $C_6$ and with KCSD substitution at $C_9$);

[SEQ ID NO: 478]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCADYGGDKKTGQAGIVGAIVDIPEISGFKEMEPMEQFIAQVDRCADCNTG
CLKGLANVKCSDLLKKWLPDRCASFADKIQKEVHNIKGMAGDR
(full-length *Metridia longa* 52 luciferase with RCAD
substitution at $C_5$ and at $C_6$ and with KCSD substitution at $C_9$);

[SEQ ID NO: 480]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCADYGGDKKTGQAGIVGAIVDIPEISGFKEMAPMEQFIAQVDRCADCTTGCL
KGLANVKCSDLLKKWLPGRCASFADKIQKEVHNIKGMAGDR
(full-length *Metridia longa* AL luciferase with RCAD
substitution at $C_5$ and at $C_6$ and with KCSD substitution at $C_9$); or (b) an amino acid sequence that shares at least 70% (and at least 71% to at least 99% and all integer percentages in between) sequence similarity or sequence identity with the sequence set forth in any one of SEQ ID NO: 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478 or 480, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above; or (c) an amino acid sequence which is encoded by the nucleotide sequence set forth in any one of:

[SEQ ID NO: 173]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngayytntgygtngaytgyacnacnggntgyytnaarggny
tngcnaaygtncartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Prolume luciferase with RCAD substitution at $C_5$);

[SEQ ID NO: 175]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngayytntgygtngaytgyacnacnggntgyytnaarggny
tngcnaaygtncartgywsngayytnytnaaraartggytnccncarmgntgygcnacnttygcnwsnaarathcarggncargtngayaar
athaarggngcnggnggngayaargaygarytn
(nucleotide sequence encoding full-length
sequence of *Gaussia princeps* Prolume KDEL luciferase with RCAD substitution at $C_5$);

[SEQ ID NO: 177]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn -continued garathccnggnttyaargayytngarccnatggarcarttyathgcncargtngayytntgygtngaytgyacnacnggntgyytnaarggny
tngcnaaygtncartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Mutant 1 luciferase with RCAD substitution at $C_5$);

[SEQ ID NO: 179]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgygcngaytaygarggngayaargarwsngcncarggnggnathggngargcnathgtngayathcc
ngarathccnggnttyaargayytngarccnytngarcarttyathgcncargtngayytntgygtngaytgyacnacnggntgyytnaarggn
ytngcnaaygtncartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Mutant 2 luciferase with RCAD substitution at $C_5$);

[SEQ ID NO: 181]

atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgygcngaytaygarggn
gayaargarwsngcncarggnggnathggngargcnathgtngayathccngarathccnggnttyaargayytngarccnatggarcartty
athgcncargtngayytntgygtngaytgyacnacnggntgyytnaarggnytngcnaaygtncartgywsngayytnytnaaraartggytn
ccncarmgntgygcnacnttygcnwsnaarathcarggncargtngayaarathaarggngcnggnggngay
(nucleotide sequence encoding full-length sequence of *Gaussia princeps* GS luciferase with RCAD
substitution at $C_5$);

[SEQ ID NO: 183]

atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtncaytgywsngcnytnytnaaraartggytnccnwsnmgntgyaaracnttygcnwsnaarathcarwsn
cargtngayacnathaarggnytngcnggngaymgn
(nucleotide sequence encoding full-
length *Metridia pacifica* 2a luciferase with RCAD substitution at $C_5$);

[SEQ ID NO: 185]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtncaytgywsngayytnytnaaraartggytnccnwsnmgntgyaaracnttygcnwsnaarathcarwsn
cargtngayacnathaarggnytngcnggngaymgn
(nucleotide sequence encoding full-
length *Metridia pacifica* 2bv1 luciferase with RCAD substitution at $C_5$);

[SEQ ID NO: 187]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnccngtngaratggargcnaaygcnaarmgngcnggntgycaymgnggntgyytnathtgyytnwsncayathaartg
yacnaaraaratgaaraarttyathccnggnmgntgygcngaytaygarggngayaargaywsngcncarggnggnathggngargarath
gtngayatgccngarathccnggnttyaargayaargarccnatggaycarttyathgcncargtngayytntgygtngaytgyacnacnggnt
gyytnaarggnytngcnaaygtncaytgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv2 luciferase with RCAD substitution at $C_5$);

[SEQ ID NO: 189]

atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytnatggaratggargcnaaygcnaarmgngcnggntgycaymgnggntgyytngtntgyytnwsncayathaartgya
cngcncaratgcaraarttyathccnggnmgntgygcngaytaygcnggngayaargaywsngcncarggnggnathgcnggnggngcn
athgtngayathccngarathgcnggnttyaargaratgaarccnatggarcarttyathgcncargtngayytntgygargaytgyacnacngg
ntgyytnaarggnytngcnaaygtncaytgywsngayytnytnaaraartggytnccnwsnmgntgyaaracnttygcnwsnaarathcar
wsncargtngayacnathaarggnytngcnggngaymgn
(nucleotide sequence encoding full-
length *Metridia longa* 22 luciferase with RCAD substitution at $C_5$);

[SEQ ID NO: 191]

atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm -continued gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaargsmytngcnggn
gaymgn
(nucleotide sequence encoding full-length *Metridia pacifica* 1v1 luciferase
with RCAD substitution at $C_5$);

[SEQ ID NO: 193]

atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding full-length *Metridia pacifica* 1v2 luciferase
with RCAD substitution at $C_5$);

[SEQ ID NO: 195]

atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngcnytnytnaaraartggytnecngaymgntgygcnwsnttygcngayaarathcarwsngargtngayaayathaarggnytngcnggn
gaymgn
(nucleotide sequence encoding full-length *Metridia pacifica* 1v3 luciferase
with RCAD substitution at $C_5$);

[SEQ ID NO: 197]

atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ygcngaytayggnggngayaaraaracnggncargcnggnathgtnggngcnathgtngayathccngayathwsnggnttyaargaratg
ggnccnatggarcarttyathgcncargtngaymgntgyacngaytgyacnacnggntgyytnaarggnytngcnaaygtnaartgywsng
arytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_5$);

[SEQ ID NO: 199]

atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgygcngaytayggnggngayaaraaracngg
ncargcnggnathgtnggngcnathgtngayathccngarathwsnggnttyaargaratggarccnatggarcarttyathgcncargtngay
ytntgygcngaytgyacnacnggntgyytnaarggnytngcnaaygtnaartgywsngarytnytnaaraartggytnccngaymgntgyg
cnwsnttygcngayaarathcaraargargcncayaayathaarggnytngcnggngaymgn
(nucleotide
sequence encoding full-length *Metridia longa* 7 luciferase with RCAD substitution at $C_5$);

[SEQ ID NO: 201]

atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgygcngaytayggnggngayaaraaracnggncargcn
ggnathgtnggngcnathgtngayathccngarathwsnggnttyaargaratggcnccnatggarcarttyathgcncargtngaymgntgy
gcnwsntgyacnacnggntgyytnaarggnytngcnaaygtnaartgywsngarytnytnaaraartggytnccngaymgntgygcnwsn
ttygcngayaarathcaraargargtncayaayathaarggnatggcnggngaymgn
(nucleotide
sequence encoding full-length *Metridia longa* GS luciferase with RCAD substitution at $C_5$);

[SEQ ID NO: 203]

atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgygcngaytayggnggngayaaraaracnggncargcnggnathgtnggngcnathgtngayathccngarathwsnggn
ttyaargaratggcnccnatggarcarttyathgcncargtngaymgntgygcnwsntgyacnacnggntgyytnaarggnytngcnaaygt
naartgywsngarytnytnaaraartggytnccngaymgntgygcnwsnttygcngayaarathcaraargargtncayaayathaarggnat
ggcnggngaymgn
(nucleotide sequence encoding full-length *Metridia longa* 164M3
luciferase with RCAD substitution at $C_5$);

[SEQ ID NO: 205]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngaymgntgygcnwsntgyacnacnggntgyytna -continued arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_5$);

[SEQ ID NO: 207]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngarmgntgygcnwsntgyacnacnggntgyytna
arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_5$);

[SEQ ID NO: 209]
atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgygcngaytayggnggngayaaraaracnggncargcnggnathgtnggngcnathgtngayathc
cngarathwsnggnttyaargaratggcnccnatggarcarttyathgcncargtngaymgntgyacnwsntgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_5$);

[SEQ ID NO: 211]
atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcnwsntgyacnacnggntgyytnaa
rggnytngcnaaygtnaartgywsngarytnytnaaraartggytnccngaymgntgygcnwsnttygcngayaarathcaraargargtnc
ayaayathaarggnatggcnggngaymgn
(nucleotide sequence encoding full-length
*Metridia longa* 45 luciferase with RCAD substitution at $C_5$);

[SEQ ID NO: 213]
atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcnwsntgyaayacnggntgyytnaa
rggnytngcnaaygtnaartgywsngarytnytnaaraartggytnccngaymgntgygcnwsnttygcngayaarathcaraargargtnc
ayaayathaarggnatggcnggngaymgn
(nucleotide sequence encoding full-length
*Metridia longa* 52 luciferase with RCAD substitution at $C_5$),

[SEQ ID NO: 215]
atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggcnccnatggarcarttyathgcncargtngayytntgygcnacntgyacnacnggntgyytnaarg
gnytngcnaaygtnaartgywsngarytnytnaaraartggytnccnggnmgntgygcnwsnttygcngayaarathcaraargargtncay
aayathaarggnatggcnggngaymgn
(nucleotide sequence encoding full-length *Metridia*
*longa* AL luciferase with RCAD substitution at $C_5$);

[SEQ ID NO: 217]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccngnttyaargayytngarccnatggarcarttyathgcncargtngaymgntgygcngaytgyacnacnggntgyytnaarggny
tngcnaaygtncartgywsngayytnytnaaraartggytnccncarmgntgygcnacnttygcnwsnaarathcarggncargtngayaa
athaarggngcnggnggngay
(nucleotide sequence encoding full-length sequence of
*Gaussia princeps* Prolume luciferase with RCAD substitution at $C_6$);

[SEQ ID NO: 219]
atgggngtnaargtnytnttygcnytnathtgyathgcngtngcngargcnaarccnacngaraayaaygargaytt
yaayathgtngcngtngcnwsnaayttygcnacnacngayymgaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng -continued arathccnggnttyaargayytngarccnatggarcarttyathgcncargtngaymgntgygcngaytgyacnacnggntgyytnaarggny
tngcnaaygtncartgywsngayytnytnaaraartggytnccncarmgntgygcnacnttygcnwsnaarathcarggncargtngayaar
athaarggngcnggnggngayaargaygarytn
(nucleotide sequence encoding full-length
sequence of *Gaussia princeps* Prolume KDEL luciferase with RCAD substitution at $C_6$);

[SEQ ID NO: 221]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngaymgntgygcngaytgyacnacnggntgyytnaarggny
tngcnaaygtncartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Mutant 1 luciferase with RCAD substitution at $C_6$);

[SEQ ID NO: 223]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgycayacntaygarggngayaargarwsngcncarggnggnathggngargcnathgtngayathccn
garathccnggnttyaargayytngarccnytngarcarttyathgcncargtngaymgntgygcngaytgyacnacnggntgyytnaargg
nytngcnaaygtncartgywsngayytnytnaaraartggytnccncarmgntgygcnacnttygcnwsnaarathcarggncargtngaya
arathaarggngcnggnggngay
(nucleotide sequence encoding full-length sequence of
*Gaussia princeps* Mutant 2 luciferase with RCAD substitution at $C_6$);

[SEQ ID NO: 225]
atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgycayacntaygarggn
gayaargarwsngcncarggnggnathggngargcnathgtngayathccngarathccnggnttyaargayytngarccnatggarcartty
athgcncargtngaymgntgygcngaytgyacnacnggntgyytnaarggnytngcnaaygtncartgywsngayytnytnaaraartggy
tnccncarmgntgygcnacnttygcnwsnaarathcarggncargtngayaarathaarggngcnggnggngay
(nucleotide sequence encoding full-length sequence of *Gaussia princeps* GS luciferase with RCAD
substitution at $C_6$);

[SEQ ID NO: 227]
atgggngtnaarytnathttygcngtnytntgygtngcngcngcncargcngcnacnathaaygaraayttygarg
ayathgaygtngtngcnathggnggnwsnttygcnytngaygtngaygcnaaymgngsnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtncaytgywsngcnytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2a luciferase with RCAD substitution at $C_6$);

[SEQ ID NO: 229]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtncaytgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv1 luciferase with RCAD substitution at $C_6$);

[SEQ ID NO: 231]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnccngtngaratggargcnaaygcnaanngngcnggntgycaymgnggntgyytnathtgyytnwsncayathaartg
yacnaaraaratgaaraarttyathccnggnmgntgycaywsntaygarggngayaargaywsngcncarggnggnathggngargarath
gtngayatgccngarathccnggnttyaargayaargarccnatggaycarttyathgcncargtngaymgntgygcngaytgyacnacngg
ntgyytnaarggnytngcnaaygtncaytgywsngayytnytnaaraartggytnccnwsnmgntgyaaracnttygcnwsnaarathcar
wsncargtngayacnathaarggnytngcnggngaymgn
(nucleotide sequence encoding full-
length *Metridia pacifica* 2bv2 luciferase with RCAD substitution at $C_6$);

[SEQ ID NO: 233]
atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytnatggaratggargcnaaygcnaarmgngcnggntgycaymgnggntgyytngtntgyytnwsncayathaartgya
cngcncaratgcaraarttyathccnggnmgntgycaywsntaygcnggngayaargaywsngcncarggnggnathgcnggnggngcn
athgtngayathccngarathgcnggnttyaargaratgaarccnatggarcarttyathgcncargtngaymgntgygcngaytgyacnacn
ggntgyytnaarggnytngcnaaygtncaytgywsngayytnytnaaraartggytnccnwsnmgntgyaaracnttygcnwsnaarathc
arwsncargtngayacnathaarggnytngcnggngaymgn
(nucleotide sequence encoding
full-length *Metridia longa* 22 luciferase with RCAD substitution at $C_6$);

-continued

[SEQ ID NO: 235]
atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v1
luciferase with RCAD substitution at $C_6$);

[SEQ ID NO: 237]
atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v2
luciferase with RCAD substitution at $C_6$);

[SEQ ID NO: 239]
atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v3
luciferase with RCAD substitution at $C_6$);

[SEQ ID NO: 241]
atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyymathtgyytnwsnaarathaartgyacngcnaaratgaaraartayathccnggnmgntg
ycaygaytayggnggngayaaraaracnggncargcnggnathgtnggngcnathgtngayathccngayathwsnggnttyaargaratg
ggnccnatggarcarttyathgcncargtngaymgntgygcngaytgyacnacnggntgyytnaarggnytngcnaaygtnaartgywsng
arytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_6$);

[SEQ ID NO: 243]
atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgycaygaytayggnggngayaaraaracngg
ncargcnggnathgtnggngcnathgtngayathccngarathwsnggnttyaargaratggarccnatggarcarttyathgcncargtngay
mgntgygcngaytgyacnacnggntgyytnaarggnymgcnaaygtnaartgywsngarytnytnaaraartggytnccngaymgntgy
gcnwsnttygcngayaarathcaraargargcncayaayathaarggnytngcnggngaymgn
(nucleotide
sequence encoding full-length *Metridia longa* 7 luciferase with RCAD substitution at $C_6$);

[SEQ ID NO: 245]
atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgycaygaytayggnggngayaaraaracnggncargcn
ggnathgtnggngcnathgtngayathccngarathwsnggnttyaargaratggcnccnatggarcarttyathgcncargtngaymgntgy
gcngaytgyacnacnggntgyytnaarggnytngcnaaygtnaartgywsngarytnytnaaraartggytnccngaymgntgygcnwsn
ttygcngayaarathcaraargargtncayaayathaarggnatggcnggngaymgn
(nucleotide
sequence encoding full-length *Metridia longa* GS luciferase with RCAD substitution at $C_6$);

[SEQ ID NO: 247]
atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgycaygaytayggnggngayaaraaracnggncargcnggnathgtnggngcnathgtngayathccngarathwsnggn
ttyaargaratggcnccnatggarcarttyathgcncargtngaymgntgygcngaytgyacnacnggntgyytnaarggnytngcnaaygtn
aartgywsngarytnytnaaraartggytnccngaymgntgygcnwsnttygcngayaarathcaraargargtncayaayathaarggnatg
gcnggngaymgn
(nucleotide sequence encoding full-length *Metridia longa* 164M3
luciferase with RCAD substitution at $C_6$);

-continued

[SEQ ID NO: 249]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaararaarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngaymgntgygcngaytgyacnacnggntgyytna
arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_6$);

[SEQ ID NO: 251]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaararaarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngarmgntgygcngaytgyacnacnggntgyytna
arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_6$);

[SEQ ID NO: 253]
atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaararaarytnccnytng
cngtnathatggaratggargcnaaygcnttyaargcnggntgyacnmgnggntgyytnathtgyytnwsnaarathaartgyacngcnaar
atgaargtntayathccnggnmgntgycaygaytayggnggngayaaraaracnggncargcnggnathgtnggngcnathgtngayathc
cngarathwsnggnttyaargaratggcnccnatggarcarttyathgcncargtngaymgntgygcngaytgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_6$);

[SEQ ID NO: 255]
atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaararaarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcngaytgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 45 luciferase with RCAD substitution at $C_6$);

[SEQ ID NO: 257]
atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaararaarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcngaytgyaayacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 52 luciferase with RCAD substitution at $C_6$);

[SEQ ID NO: 259]
atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaayttygtngcnacngaracngaygcnaaymgnggnaaratgccnggnaararaarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggcnccnatggarcarttyathgcncargtngaymgntgygcngaytgyacnacnggntgyytnaa
rggnytngcnaaygtnaartgywsngarytnytnaaraartggytnccnggnmgntgygcnwsnttygcngayaarathcaraargargtnc
ayaayathaarggnatggcnggngaymgn
(nucleotide sequence encoding full-length
*Metridia longa* AL luciferase with RCAD substitution at $C_6$);

-continued

[SEQ ID NO: 261]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngayytntgygtngaytgyacnacnggntgyytnaarggnyt
ngcnaaygtnaartgywsngayytnytnaaraartggytnccncarmgntgygcnacnttygcnwsnaarathcarggncargtngayaara
thaarggngcnggnggngay
(nucleotide sequence encoding full-length sequence of
*Gaussia princeps* Prolume luciferase with KCSD substitution at $C_9$);

[SEQ ID NO: 263]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngayytntgygtngaytgyacnacnggntgyytnaarggnyt
ngcnaaygtnaartgywsngayytnytnaaraartggytnccncarmgntgygcnacnttygcnwsnaarathcarggncargtngayaara
thaarggngcnggnggngayaargaygarytn
(nucleotide sequence encoding full-length
sequence of *Gaussia princeps* Prolume KDEL luciferase with KCSD substitution at $C_9$);

[SEQ ID NO: 265]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngayytntgygtngaytgyacnacnggntgyytnaarggnyt
ngcnaaygtnaartgywsngayytnytnaaraartggytnccncarmgntgygcnacnttygcnwsnaarathcarggncargtngayaara
thaarggngcnggnggngay
(nucleotide sequence encoding full-length sequence of
*Gaussia princeps* Mutant 1 luciferase with KCSD substitution at $C_9$);

[SEQ ID NO: 267]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgycayacntaygarggngayaargarwsngcncarggnggnathggngargcnathgtngayathccn
garathccnggnttyaargayytngarccnytngarcarttyathgcncargtngayytntgygtngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Mutant 2 luciferase with KCSD substitution at $C_9$);

[SEQ ID NO: 269]

atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgycayacntaygarggn
gayaargarwsngcncarggnggnathggngargcnathgtngayathccngarathccnggnttyaargayytngarccnatggarcartty
athgcncargtngayytntgygtngaytgyacnacnggntgyytnaarggnytngcnaaygtnaartgywsngayytnytnaaraartggytn
ccncarmgntgygcnacnttygcnwsnaarathcarggncargtngayaarathaarggngcnggnggngay
(nucleotide sequence encoding full-length sequence of *Gaussia princeps* GS luciferase with KCSD
substitution at $C_9$)

[SEQ ID NO: 271]

atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaararat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtnaartgywsngayytnytnaaraartggytnccnwsnmgntgyaaracnttygcnwsnaarathcarwsn
cargtngayacnathaarggnytngcnggngaymgn
(nucleotide sequence encoding full-
length *Metridia pacifica* 2a luciferase with KCSD substitution at $C_9$);

[SEQ ID NO: 273]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaararat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtnaartgywsngayytnytnaaraartggytnccnwsnmgntgyaaracnttygcnwsnaarathcarwsn
cargtngayacnathaarggnytngcnggngaymgn
(nucleotide sequence encoding full-
length *Metridia pacifica* 2bv1 luciferase with KCSD substitution at $C_9$);

[SEQ ID NO: 275]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaararat
gccnaargargtnccngtngaratggargcnaaygcnaarmgngcnggntgycaymgnggntgyytnathtgyytnwsncayathaartg -continued yacnaaraaratgaaraarttyathccnggnmgntgycaywsntaygarggngayaargaywsngcncarggnggnathggngargarath
gtngayatgccngarathccnggnttyaargayaargarccnatggaycarttyathgcncargtngayytntgygtngaytgyacnacnggnt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv2 luciferase with KCSD substitution at $C_9$);

[SEQ ID NO: 277]
atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytaatggaratggargcnaaygcnaarmgngcnggntgycaymgnggntgyytngtntgyytnwsncayathaartgya
cngcncaratgcaraarttyathccnggnmgntgycaywsntaygcnggngayaargaywsngcncarggnggnathgcnggnggngcn

[SEQ ID NO: 277]
athgtngayathccngarathgcnggnttyaargaratgaarccnatggarcarttyathgcncargtngayytntgygargaytgyacnacngg
ntgyytnaarggnytngcnaaygtnaartgywsngayytnytnaaraartggytnccnwsnmgntgyaaracnttygcnwsnaarathcar
wsncargtngayacnathaarggnytngcnggngaymgn
(nucleotide sequence encoding full-
length *Metridia longa* 22 luciferase with KCSD substitution at $C_9$);

[SEQ ID NO: 279]
atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v1 luciferase
with KCSD substitution at $C_9$);

[SEQ ID NO: 281]
atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v2 luciferase
with KCSD substitution at $C_9$);

[SEQ ID NO: 283]
atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v3 luciferase
with KCSD substitution at $C_9$);

[SEQ ID NO: 285]
atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ycaygaytayggnggngayaaraaracnggncargcnggnathgtnggngcnathgtngayathccngayathwsnggnttyaargaratg
ggnccnatggarcarttyathgcncargtngaymgntgyacngaytgyacnacnggntgyytnaarggnytngcnaaygtnaartgywsng
ayytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
KCSD substitution at $C_9$);

[SEQ ID NO: 287]
atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgycaygaytayggnggngayaaraaracngg
ncargcnggnathgtnggngcnathgtngayathccngarathwsnggnttyaargaratggarccnatggarcarttyathgcncargtngay
ytntgygcngaytgyacnacnggntgyytnaarggnytngcnaaygtnaartgywsngayytnytnaaraatggytnccngaymgntgyg
cnwsnttygcngayaarathcaraargargcncayaayathaarggnytngcnggngaymgn
(nucleotide
sequence encoding full-length *Metridia longa* 7 luciferase with KCSD substitution at $C_9$);

[SEQ ID NO: 289]
atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg -continued yytnwsnaarathaartgyacngcnaaratgaargtntayathccnggnmgntgycaygaytayggnggngayaaraaracnggncargcn
ggnathgtnggngcnathgtngayathccngarathwsnggnttyaargaratggcnccnatggarcarttyathgcncargtngaymgntgy
gcnwsntgyacnacnggntgyytnaarggnytngcnaaygtnaartgywsngayytnytnaaraartggytnccngaymgntgygcnws
nttygcngayaarathcaraargargtncayaayathaarggnatggcnggngaymgn
(nucleotide
sequence encoding full-length *Metridia longa* GS luciferase with KCSD substitution at $C_9$);

[SEQ ID NO: 291]

atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgycaygaytayggnggngayaaraaracnggncargcnggnathgtnggngcnathgtngayathccngarathwsnggn
ttyaargaratggcnccnatggarcarttyathgcncargtngaymgntgygcnwsntgyacnacnggntgyytnaarggnytngcnaaygt
naartgywsngayytnytnaaraartggytnccngaymgntgygcnwsnttygcngayaarathcaraargargtncayaayathaarggna
tggcnggngaymgn
(nucleotide sequence encoding full-length *Metridia longa* 164M3
luciferase with KCSD substitution at $C_9$);

[SEQ ID NO: 293]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngaymgntgygcnwsntgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with KCSD substitution at $C_9$);

[SEQ ID NO: 295]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngarmgntgygcnwsntgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with KCSD substitution at $C_9$);

[SEQ ID NO: 297]

atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgycaygaytayggnggngayaaraaracnggncargcnggnathgtnggngcnathgtngayathc
cngarathwsnggnttyaargaratggcnccnatggarcarttyathgcncargtngaymgntgyacnwsntgyacnacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with KCSD substitution at $C_9$);

[SEQ ID NO: 299]

atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcnwsntgyacnacnggntgyytnaa
rggnytngcnaaygtnaartgywsngayytnytnaaraartggytnccngaymgntgygcnwsnttygcngayaarathcaraargargtnc
ayaayathaarggnatggcnggngaymgn
(nucleotide sequence encoding full-length
*Metridia longa* 45 luciferase with KCSD substitution at $C_9$);

[SEQ ID NO: 301]

atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcnwsntgyaayacnggntgyytnaa
rggnytngcnaaygtnaartgywsngayytnytnaaraartggytnccngaymgntgygcnwsnttygcngayaarathcaraargargtnc
ayaayathaarggnatggcnggngaymgn
(nucleotide sequence encoding full-length
*Metridia longa* 52 luciferase with KCSD substitution at $C_9$);

[SEQ ID NO: 303]

atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng -continued ayathacngayacngaymgngtnwsnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccnganrthwsnggnttyaargaratggcnccnatggarcarttyathgcncargtngayytntgygcnacntgyacnacnggntgyytnaarg
gnytngcnaaygtnaartgywsngayytnytnaaraartggytnccnggnmgntgygcnwsnttygcngayaarathcaraargargtnca
yaayathaarggnatggcnggngaymgn
(nucleotide sequence encoding full-length
*Metridia longa* AL luciferase with KCSD substitution at $C_9$);

[SEQ ID NO: 305]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtncartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Prolume luciferase with RCAD substitution at $C_5$ and at $C_6$);

[SEQ ID NO: 307]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtncartgywsngayytnytnaaraartggytnccncarmgntgygcnacnttygcnwsnaarathcarggncargtngayaa
rathaarggngcnggnggngayaargaygarytn
(nucleotide sequence encoding full-length
sequence of *Gaussia princeps* Prolume KDEL luciferase with RCAD substitution at $C_5$ and at $C_6$);

[SEQ ID NO: 309]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtncartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Mutant 1 luciferase with RCAD substitution at $C_5$ and at $C_6$);

[SEQ ID NO: 311]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgygcngaytaygarggngayaargarwsngcncarggnggnathggngargcnathgtngayathcc
ngarathccnggnttyaargayytngarccnytngarcarttyathgcncargtngaymgntgygcngaytgyacnacnggntgyytnaarg
gnytngcnaaygtncartgywsngayytnytnaaraartggytnccncarmgntgygcnacnttygcnwsnaarathcarggncargtngay
aarathaarggngcnggnggngay
(nucleotide sequence encoding full-length sequence of
*Gaussia princeps* Mutant 2 luciferase with RCAD substitution at $C_5$);

[SEQ ID NO: 313]

atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgygcngaytaygarggn
gayaargarwsngcncarggnggnathggngargcnathgtngayathccngarathccnggnttyaargayytngarccnatggarcartty
athgcncargtngaymgntgygcngaytgyacnacnggntgyytnaarggnytngcnaaygtncartgywsngayytnytnaaraartggy
tnccncarmgntgygcnacnttygcnwsnaarathcarggncargtngayaarathaarggngcnggnggngay
(nucleotide sequence encoding full-length sequence of *Gaussia princeps* GS luciferase with RCAD
substitution at $C_5$ and at $C_6$);

[SEQ ID NO: 315]

atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtncaytgywsngcnytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2a luciferase with RCAD substitution at $C_5$ and at $C_6$);

-continued

[SEQ ID NO: 317]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtncaytgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv1 luciferase with RCAD substitution at $C_5$ and at $C_6$);

[SEQ ID NO: 319]
atgggngtnaarytnathttygcngtngtntgygtagcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnccngtngaratggargcnaaygcnaarmgngcnggntgycaymgnggntgyytnathtgyytnwsncayathaartg
yacnaaraaratgaaraarttyathccnggnmgntgygcngaytaygarggngayaargaywsngcncarggnggnathggngargarath
gtngayatgccngarathccnggnttyaargayaargarccnatggaycarttyathgcncargtngaymgntgygcngaytgyacnacngg
ntgyytnaarggnytngcnaaygtncaytgywsngayytnytnaaraartggytnccnwsnmgntgyaaracnttygcnwsnaarathcar
wsncargtngayacnathaarggnytngcnggngaymgn
(nucleotide sequence encoding full-
length *Metridia pacifica* 2bv2 luciferase with RCAD substitution at $C_5$ and at $C_6$);

[SEQ ID NO: 321]
atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytnatggaratggargcnaaygcnaarmgngcnggntgycaymgnggntgyytngtntgyytnwsncayathaartgya
cngcncaratgcaraarttyathccnggnmgntgygcngaytaygcnggngayaargaywsngcncarggnggnathgcnggnggngcn
athgtngayathccngarathgcnggnttyaargaratgaarccnatggarcarttyathgcncargtngaymgntgygcngaytgyacnacn
ggntgyytnaarggnytngcnaaygtncaytgywsngayytnytnaaraartggytnccnwsnmgmtgyaaracnttygcnwsnaarathc
arwsncargtngayacnathaarggnytngcnggngaymgn
(nucleotide sequence encoding
full-length *Metridia longa* 22 luciferase with RCAD substitution at $C_5$ and at $C_6$);

[SEQ ID NO: 323]
atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v1
luciferase with RCAD substitution at $C_5$ and at $C_6$);

[SEQ ID NO: 325]
atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v2
luciferase with RCAD substitution at $C_5$ and at $C_6$);

[SEQ ID NO: 327]
atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngcnytnytnaaraartggytnccngaymgntgygcnwsnttygcngayaarathcarwsngargtngayaayathaarggnytngcn
ggngaymgn
(nucleotide sequence encoding full-length *Metridia pacifica* 1v3
luciferase with RCAD substitution at $C_5$ and at $C_6$);

[SEQ ID NO: 329]
atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ygcngaytayggnggngayaaraaracnggncargcnggnathgtnggngcnathgtngayathccngayathwsnggnttyaargaratg
ggnccnatggarcarttyathgcncargtngaymgntgygcngaytgyacnacnggntgyytnaarggnytngcnaaygtnaartgywsng
arytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_5$ and at $C_6$);

-continued

[SEQ ID NO: 331]
atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgygcngaytayggnggngayaaraaracngg
ncargcnggnathgtnggngcnathgtngayathccngarathwsnggnttyaargaratggarccnatggarcarttyathgcncargtngay
mgntgygcngaytgyacnacnggntgyytnaarggnytngcnaaygtnaartgywsngarytnytnaaraartggytnccngaymgntgy
gcnwsnttygcngayaarathcaraargargcncayaayathaarggnytngcnggngaymgn
(nucleotide
sequence encoding full-length *Metridia longa* 7 luciferase with RCAD substitution at $C_5$ and at $C_6$);

[SEQ ID NO: 333]
atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgygcngaytayggnggngayaaraaracnggncargcn
ggnathgtnggngcnathgtngayathccngarathwsnggnttyaargaratggcnccnatggarcarttyathgcncargtngaymgntgy
gcngaytgyacnacnggntgyytnaarggnytngcnaaygtnaartgywsngarytnytnaaraartggytnccngaymgntgygcnwsn
ttygcngayaarathcaraargargtncayaayathaarggnatggcnggngaymgn
(nucleotide
sequence encoding full-length *Metridia longa* GS luciferase with RCAD substitution at $C_5$ and at $C_6$);

[SEQ ID NO: 335]
atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgygcngaytayggnggngayaaraaracnggncargcnggnathgtnggngcnathgtngayathccngarathwsnggn
ttyaargaratggcnccnatggarcarttyathgcncargtngaymgntgygcngaytgyacnacnggntgyytnaarggnytngcnaaygtn
aartgywsngarytnytnaaraartggytnccngaymgntgygcnwsnttygcngayaarathcaraargargtncayaayathaarggnatg
gcnggngaymgn
(nucleotide sequence encoding full-length *Metridia longa* 164M3
luciferase with RCAD substitution at $C_5$ and at $C_6$);

[SEQ ID NO: 337]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngaymgntgygcngaytgyacnacnggntgyytna
arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_5$ and at $C_6$);

[SEQ ID NO: 339]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngarmgntgygcngaytgyacnacnggntgyytna
arggnytngcnaaygtnaartgywsngarytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_5$ and at $C_6$);

[SEQ ID NO: 341]
atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgygcngaytayggnggngayaaraaracnggncargcnggnathgtnggngcnathgtngayathc
cngarathwsnggnttyaargaratggcnccnatggarcarttyathgcncargtngaymgntgygcngaytgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_5$ and at $C_6$);

[SEQ ID NO: 343]
atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcngaytgyacnacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 45 luciferase with RCAD substitution at $C_5$ and at $C_6$);

-continued

[SEQ ID NO: 345]

atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcngaytgyaayacnggntgyytnaar
ggnytngcnaaygtnaartgywsngarytnytnaaraartggytnccngaymgntgygcnwsnttygcngayaarathcaraargargtnca
yaayathaarggnatggcnggngaymgn
(nucleotide sequence encoding full-length
*Metridia longa* 52 luciferase with RCAD substitution at $C_5$ and at $C_6$);

[SEQ ID NO: 347]

atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggcnccnatggarcarttyathgcncargtngaymgntgygcngaytgyacnacnggntgyytnaa
rggnytngcnaaygtnaartgywsngarytnytnaaraartggytnccnggnmgntgygcnwsnttygcngayaarathcaraargargtn
ayaayathaarggnatggcnggngaymgn
(nucleotide sequence encoding full-length
*Metridia longa* AL luciferase with RCAD substitution at $C_5$ and at $C_6$);

[SEQ ID NO: 349]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngayytntgygtngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Prolume luciferase with RCAD substitution at $C_5$ and with KCSD substitution at
$C_9$);

[SEQ ID NO: 351]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngayytntgygtngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngayaargaygarytn
(nucleotide sequence encoding full-length
sequence of *Gaussia princeps* Prolume KDEL luciferase with RCAD substitution at $C_5$ and with
KCSD substitution at $C_9$);

[SEQ ID NO: 353]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngayytntgygtngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Mutant 1 luciferase with RCAD substitution at $C_5$ and with KCSD substitution at
$C_9$);

[SEQ ID NO: 355]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgygcngaytaygarggngayaargarwsngcncarggnggnathggngargcnathgtngayathcc
ngarathccnggnttyaargayytngarccnytngarcarttyathgcncargtngayytntgygtngaytgyacnacnggntgyytnaarggn
ytngcnaaygtnaartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Mutant 2 luciferase with RCAD substitution at $C_5$ and with KCSD substitution at
$C_9$);

-continued

[SEQ ID NO: 357]

atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgygcngaytaygarggn
gayaargarwsngcncarggnggnathggngargcnathgtngayathccngarathccnggnttyaargayytngarccnatggarcartty
athgcncargtngayytntgygtngaytgyacnacnggntgyytnaarggnytngcnaaygtnaartgywsngayytnytnaaraartggytn
ccncarmgntgygcnacnttygcnwsnaarathcarggncargtngayaarathaarggngcnggnggngay
(nucleotide sequence encoding full-length sequence of *Gaussia princeps* GS luciferase with RCAD substitution at $C_5$ and with KCSD substitution at $C_9$);

[SEQ ID NO: 359]

atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtnaartgywsngayytnytnaaraartggytnccnwsnmgntgyaaracnttygcnwsnaarathcarwsn
cargtngayacnathaarggnytngcnggngaymgn
(nucleotide sequence encoding full-length *Metridia pacifica* 2a luciferase with RCAD substitution at $C_5$ and with KCSD substitution at $C_9$);

[SEQ ID NO: 361]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngayytntgygtngaytgyacnacnggntg
yytnaarggnytngcnaaygtnaartgywsngayytnytnaaraartggytnccnwsnmgntgyaaracnttygcnwsnaarathcarwsn
cargtngayacnathaarggnytngcnggngaymgn
(nucleotide sequence encoding full-length *Metridia pacifica* 2bv1 luciferase with RCAD substitution at $C_5$ and with KCSD substitution at $C_9$);

[SEQ ID NO: 363]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnccngtngaratggargcnaaygcnaamgngcnggntgycaymgnggntgyytnathtgyytnwsncayathaartg
yacnaaraaratgaaraarttyathccnggnmgntgygcngaytaygarggngayaargaywsngcncarggnggnathggngargarath
gtngayatgccngarathccnggnttyaargayaargarccnatggaycarttyathgcncargtngayytntgygtngaytgyacnacnggnt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-length *Metridia pacifica* 2bv2 luciferase with RCAD substitution at $C_5$ and with KCSD substitution at $C_9$);

[SEQ ID NO: 365]

atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytnatggaratggargcnaaygcnaarmgngcnggntgycaymgnggntgyytngtntgyytnwsncayathaartgya
cngcncaratgcaraarttyathccnggnmgntgygcngaytaygcnggngayaargaywsngcncarggnggnathgcnggnggngcn
athgtngayathccngarathgcnggnttyaargaratgaarccnatggarcarttyathgcncargtngayytntgygargaytgyacnacngg
ntgyytnaarggnytngcnaaygtnaartgywsngayytnytnaaraartggytnccnwsnmgntgyaaracnttygcnwsnaarathcar
wsncargtngayacnathaarggnytngcnggngaymgn
(nucleotide sequence encoding full-length *Metridia longa* 22 luciferase with RCAD substitution at $C_5$ and with KCSD substitution at $C_9$);

[SEQ ID NO: 367]

atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v1 luciferase with RCAD substitution at $C_5$ and with KCSD substitution at $C_9$);

[SEQ ID NO: 369]

atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v2 luciferase with RCAD substitution at $C_5$ and with KCSD substitution at $C_9$);

-continued

[SEQ ID NO: 371]
atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding full-length *Metridia pacifica* 1v3 luciferase
with RCAD substitution at $C_5$ and with KCSD substitution at $C_9$);

[SEQ ID NO: 373]
atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ygcngaytayggnggngayaaraaracnggncargcnggnathgtnggngcnathgtngayathccngayathwsnggnttyaargaratg
ggnccnatggarcarttyathgcncargtngaymgntgyacngaytgyacnacnggntgyytnaarggnytngcnaaygtnaartgywsng
ayytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_5$ and with KCSD substitution at $C_9$);

[SEQ ID NO: 375]
atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgygcngaytayggnggngayaaraaracngg
ncargcnggnathgtnggngcnathgtngayathccngarathwsnggnttyaargaratggarccnatggarcarttyathgcncargtngay
ytntgygcngaytgyacnacnggntgyytnaarggnytngcnaaygtnaartgywsngayytnytnaaraartggytnccngaymgntgyg
cnwsnttygcngayaarathcaraargargcncayaayathaarggnytngcnggngaymgn
(nucleotide
sequence encoding full-length *Metridia longa* 7 luciferase with RCAD substitution at $C_5$ and with
KCSD substitution at $C_9$);

[SEQ ID NO: 377]
atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgygcngaytayggnggngayaaraaracnggncargcn
ggnathgtnggngcnathgtngayathccngarathwsnggnttyaargaratggcnccnatggarcarttyathgcncargtngaymgntgy
gcnwsntgyacnacnggntgyytnaarggnytngcnaaygtnaartgywsngayytnytnaaraartggytnccngaymgntgygcnws
nttygcngayaarathcaraargargtncayaayathaarggnatggcnggngaymgn
(nucleotide
sequence encoding full-length *Metridia longa* GS luciferase with RCAD substitution at $C_5$ and with
KCSD substitution at $C_9$);

[SEQ ID NO: 379]
atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgygcngaytayggnggngayaaraaracnggncargcnggnathgtnggngcnathgtngayathccngarathwsnggn
ttyaargaratggcnccnatggarcarttyathgcncargtngaymgntgygcnwsntgyacnacnggntgyytnaarggnytngcnaaygt
naartgywsngayytnytnaaraartggytnccngaymgntgygcnwsnttygcngayaarathcaraargargtncayaayathaarggna
tggcnggngaymgn
(nucleotide sequence encoding full-length *Metridia longa* 164M3
luciferase with RCAD substitution at $C_5$ and with KCSD substitution at $C_9$);

[SEQ ID NO: 381]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngaymgntgygcnwsntgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_5$ and with KCSD substitution at $C_9$);

[SEQ ID NO: 383]
atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngarmgntgygcnwsntgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_5$ and with KCSD substitution at $C_9$);

-continued

[SEQ ID NO: 385]

atggayatgaargtnathttygcnytnathttywsngcnytngtncargcnaarwsnacngarttygayccnaayat
hgayathgtnggnytngarggnaarttyggnathacnaayytngaracngayytntryacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnrngnggntgyytnathtgyytnwsnaarathaartgyacngcnaar
atgaargtntayathccnggnmgntgygcngaytayggnggngayaaraaracnggncargcnggnathgtnggngcnathgtngayathc
cngarathwsnggnttyaargaratggcnccnatggarcarttyathgcncargtngaymgntgyacnwsntgyacnacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_5$ and with KCSD substitution at $C_9$);

[SEQ ID NO: 387]

atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcnwsntgyacnacnggntgyytnaa
rggnytngcnaaygtnaartgywsngayytnytnaaraartggytnccngaymgntgygcnwsnttygcngayaarathcaraargargtnc
ayaayathaarggnatggcnggngaymgn
(nucleotide sequence encoding full-length
*Metridia longa* 45 luciferase with RCAD substitution at $C_5$ and with KCSD substitution at $C_9$);

[SEQ ID NO: 389]

atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcnwsntgyaayacnggntgyytnaa
rggnytngcnaaygtnaartgywsngayytnytnaaraartggytnccngaymgntgygcnwsnttygcngayaarathcaraargargtnc
ayaayathaarggnatggcnggngaymgn
(nucleotide sequence encoding full-length
*Metridia longa* 52 luciferase with RCAD substitution at $C_5$ and with KCSD substitution at $C_9$)

[SEQ ID NO: 391]

atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaaytrygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggcnccnatggarcarttyathgcncargtngayytntgygcnacntgyacnacnggntgyytnaarg
gnytngcnaaygtnaartgywsngayytnytnaaraartggytnccnggnmgntgygcnwsnttygcngayaarathcaraargargtnca
yaayathaarggnatggcnggngaymgn
(nucleotide sequence encoding full-length
*Metridia longa* AL luciferase with RCAD substitution at $C_5$ and with KCSD substitution at $C_9$);

[SEQ ID NO: 393]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayymgarccnatggarcarttyathgcncargtngaymgntgygcngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Prolume luciferase with RCAD substitution at $C_6$ and with KCSD substitution at
$C_9$);

[SEQ ID NO: 395]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngaymgntgygcngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngayaargaygarytn
(nucleotide sequence encoding full-length
sequence of *Gaussia princeps* Prolume KDEL luciferase with RCAD substitution at $C_6$ and with
KCSD substitution at $C_9$);

-continued

[SEQ ID NO: 397]
atgggngtnaargtnytnttygcnytnathtgyathgcngtngcngargcnaarccnacngaraayaaygargaytt
yaayathgtngcngtngcnwsnaaytrygcnacnacngayytngaygcngaymgnggnaarytnccnggnaararytnccnytngargt
nytnaargarathgargcnaaygcnmgnaargcnggntgyacnmgnggntgyytnathtgyytnwsncayathaartgyacnccnaaratg
aaraarttyathccnggnmgntgycayacntaygarggngayaargarwsngcncarggnggnathggngargcnathgtngayathccng
arathccnggnttyaargayytngarccnatggarcarttyathgcncargtngaymgntgygcngaytgyacnacnggntgyytnaarggny
tngcnaaygtnaartgywsngayytnytnaaraartggytnccncarmgntgygcnacnttygcnwsnaarathcarggncargtngayaar
athaarggngcnggnggngay
(nucleotide sequence encoding full-length sequence of
*Gaussia princeps* Mutant 1 luciferase with RCAD substitution at $C_6$ and with KCSD substitution at
$C_9$);

[SEQ ID NO: 399]
atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaararytnccnytngargt
nytnaargarytngargcnaaygcnmgnaargcnggntgyacnmgnggntgyytnathtgyytnwsncayathaartgyacnccnaarat
gaaraarttyathccnggnmgntgycayacntaygarggngayaargarwsngcncarggnggnathggngargcnathgtngayathccn
garathccnggnrryaargayytngarccnytngarcarttyathgcncargtngaymgntgygcngaytgyacnacnggntgyytnaargg
nytngcnaaygtnaartgywsngayytnytnaaraartggytnccncarmgntgygcnacnttygcnwsnaarathcarggncargtngaya
arathaarggngcnggnggngay
(nucleotide sequence encoding full-length sequence of
*Gaussia princeps* Mutant 2 luciferase with RCAD substitution at $C_6$ and with KCSD substitution at
$C_9$);

[SEQ ID NO: 401]
atggargcnaarccnacngaraayaaygargayttyaayathgtngcngtngcnwsnaayttygcnacnacnga
yytngaygcngaymgnggnaarytnccnggnaararytnccnytngargtnytnaargaratggargcnaaygcnmgnaargcnggntg
yacnmgnggntgyytnathtgyytnwsncayathaartgyacnccnaaratgaaraarttyathccnggnrngntgycayacntaygarggn
gayaargarwsngcncarggnggnathggngargcnathgtngayathccngarathccnggnrtyaargayytngarccnatggarcartty
athgcncargtngaymgntgygcngaytgyacnacnggntgyytnaarggnytngcnaaygtnaartgywsngayytnytnaaraartggy
tnccncarmgntgygcnacnttygcnwsnaarathcarggncargtngayaarathaarggngcnggnggngay
(nucleotide sequence encoding full-length sequence of *Gaussia princeps* GS luciferase with RCAD
substitution at $C_6$ and with KCSD substitution at $C_9$);

[SEQ ID NO: 403]
atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaararat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2a luciferase with RCAD substitution at $C_6$ and with KCSD substitution at
$C_9$);

[SEQ ID NO: 405]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaararat
gccnaargargtnytngtngaratggargcnaaygcnaarmgngcnggntgycaymgnggntgyytnathtgyytnwsncayathaartgy
acnaaraaratgaaraarttyathccnggnmgntgycaywsntaygarggngayaargaywsngcncarggnggnathggngargarathg
tngayatgccngarathccnggnttyaargayaargarccnatggaycarttyathgcncargtngaymgntgygcngaytgyacnacnunt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv1 luciferase with RCAD substitution at $C_6$ and with KCSD substitution at
$C_9$);

[SEQ ID NO: 407]
atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaararat
gccnaargargtnccngtngaratggargcnaaygcnaarmgngcnggntgycaymgnggntgyytnathtgyytnwsncayathaartg
yacnaaraaratgaaraarttyathccnggnmgntgycaywsntaygarggngayaargaywsngcncarggnggnathggngargarath
gtngayatgccngarathccnggnttyaargayaargarccnatggaycarttyathgcncargtngaymgntgygcngaytgyacnacngg
ntgyytnaarggnytngcnaaygtnaartgywsngayytnytnaaraartggytnccnwsnmgntgyaaracnttygcnwsnaarathcar
wsncargtngayacnathaarggnytngcnggngaymgn
(nucleotide sequence encoding full-
length *Metridia pacifica* 2bv2 luciferase with RCAD substitution at $C_6$ and with KCSD
substitution at $C_9$);

[SEQ ID NO: 409]
atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaararatg
ccnaargargtnytnatggaratggargcnaaygcnaarmgngcnggntgycaymgnggntgyytngtntgyytnwsncayathaartgya
cngcncaratgcaraarttyathccnggnmgntgycaywsntaygcnggngayaargaywsngcncarggnggnathgcnggnggngcn -continued athgtngayathccngarathgcnggnttyaargaratgaarccnatggarcarttyathgcncargtngaymgntgygcngaytgyacnacn
ggntgyytnaarggnytngcnaaygtnaartgywsngayytnytnaaraartggytnccnwsnmgntgyaaracnttygcnwsnaarathc
arwsncargtngayacnathaarggnytngcnggngaymgn
(nucleotide sequence encoding
full-length *Metridia longa* 22 luciferase with RCAD substitution at $C_6$ and with KCSD
substitution at $C_9$);

[SEQ ID NO: 411]

atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v1
luciferase with RCAD substitution at $C_6$ and with KCSD substitution at $C_9$);

[SEQ ID NO: 413]

atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnyngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v2
luciferase with RCAD substitution at $C_6$ and with KCSD substitution at $C_9$);

[SEQ ID NO: 415]

atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgycaygaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v3
luciferase with RCAD substitution at $C_6$ and with KCSD substitution at $C_9$);

[SEQ ID NO: 417]

atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ycaygaytayggnggngayaaraaracnggncargcnggnathgtnggngcnathgtngayathccngayathwsnggnttyaargaratg
ggnccnatggarcarttyathgcncargtngaymgntgygcngaytgyacnacnggntgyytnaarggnytngcnaaygtnaartgywsng
ayytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_6$ and with KCSD substitution at $C_9$);

[SEQ ID NO: 419]

atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgycaygaytayggnggngayaaraaracngg
ncargcnggnathgtnggngcnathgtngayathccngarathwsnggnttyaargaratggarccnatggarcarttyathgcncargtngay
mgntgygcngaytgyacnacnggntgyytnaarggnytngcnaaygtnaartgywsngayytnytnaaraartggytnccngaymgntgy
gcnwsnttygcngayaarathcaraargargcncayaayathaarggnytngcnggngaymgn
(nucleotide
sequence encoding full-length *Metridia longa* 7 luciferase with RCAD substitution at $C_6$ and with
KCSD substitution at $C_9$);

[SEQ ID NO: 421]

atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgycaygaytayggnggngayaaraaracnggncargcn
ggnathgtnggngcnathgtngayathccngarathwsnggnttyaargaratggcnccnatggarcarttyathgcncargtngaymgntgy
gcngaytgyacnacnggntgyytnaarggnytngcnaaygtnaartgywsngayytnytnaaraartggytnccngaymgntgygcnwn
ttygcngayaarathcaraargargtncayaayathaarggnatggcnggngaymgn
(nucleotide
sequence encoding full-length *Metridia longa* GS luciferase with RCAD substitution at $C_6$ and
with KCSD substitution at $C_9$);

[SEQ ID NO: 423]

atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc -continued cnggnmgntgycaygaytayggnggngayaaraaracnggncargcnggnathgtnggngcnathgtngayathccngarathwsnggn
ttyaargaratggcnccnatggarcarttyathgcncargtngaymgntgygcngaytgyacnacnggntgyytnaarggnytngcnaaygtn
aartgywsngayytnytnaaraartggytnccngaymgntgygcnwsnttygcngayaarathcaraargargtncayaayathaarggnat
ggcnggngaymgn
(nucleotide sequence encoding full-length *Metridia longa* 164M3
luciferase with RCAD substitution at $C_6$ and with KCSD substitution at $C_9$);

[SEQ ID NO: 425]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngaymgntgygcngaytgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_6$ and with KCSD substitution at $C_9$);

[SEQ ID NO: 427]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgycaygaytayggnggngayaaraaracnggncargcnggnathgtnggngcnathgtngayat
hccngarathwsnggnttyaargaratggcnccnatggarcarttyathgcncargtngarmgntgygcngaytgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_6$ and with KCSD substitution at $C_9$);

[SEQ ID NO: 429]

atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgycaygaytayggnggngayaaraaracnggncargcnggnathgtnggngcnathgtngayathc
cngarathwsnggnttyaargaratggcnccnatggarcarttyathgcncargtngaymgntgygcngaytgyacnacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_6$ and with KCSD substitution at $C_9$);

[SEQ ID NO: 431]

atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcngaytgyacnacnggntgyytnaar
ggnytngcnaaygtnaartgywsngayytnytnaaraartggartnccngaymgntgygcnwsnttygcngayaarathcaraargargtnca
yaayathaarggnatggcnggngaymgn
(nucleotide sequence encoding full-length
*Metridia longa* 45 luciferase with RCAD substitution at $C_6$ and with KCSD substitution at $C_9$);

[SEQ ID NO: 433]

atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggarccnatggarcarttyathgcncargtngaymgntgygcngaytgyaayacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 52 luciferase with RCAD substitution at $C_6$ and with KCSD substitution at $C_9$);

[SEQ ID NO: 435]

atggayatgmgngtnathttygcnytngtnttywsnwsnytngtncargcnaarwsnacngarttygayccnaay
athaayathgtnggnytngarggnaarttyggnathacnaayytngaracngayytnttyacathtgggaracnatggaygtnathaarwsng
ayathacngayacngaymgngtnwsnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgycaygaytayggnggngayaaraaracnggncargcnggnathgtnggngcnathgtngayath
ccngarathwsnggnttyaargaratggcnccnatggarcarttyathgcncargtngaymgntgygcngaytgyacnacnggntgyytnaa
rggnytngcnaaygtnaartgywsngayytnytnaaraartggytnccnggnmgntgygcnwsnttygcngayaarathcaraargargtnc
ayaayathaarggnatggcnggngaymgn
(nucleotide sequence encoding full-length
*Metridia longa* AL luciferase with RCAD substitution at $C_6$ and with KCSD substitution at $C_9$);

-continued

[SEQ ID NO: 437]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtnaartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Prolume luciferase with RCAD substitution at $C_5$ and at $C_6$ and with KCSD
substitution at $C_9$);

[SEQ ID NO: 439]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargaratggargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtnaartgywsngayytnytnaaraartggytnccncarmgntgygcnacnttygcnwsnaarathcarggncargtngayaa
rathaarggngcnggnggngayaargaygarytn
(nucleotide sequence encoding full-length
sequence of *Gaussia princeps* Prolume KDEL luciferase with RCAD substitution at $C_5$ and at $C_6$
and with KCSD substitution at $C_9$);

[SEQ ID NO: 441]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarathgargcnaaygcnmgnaargcnggntgyacnmgnggntgyytnathtgyytnwsncayathaartgyacnccnaaratg
aaraarttyathccnggnmgntgygcngaytaygarggngayaargarwsngcncarggnggnathggngargcnathgtngayathccn
garathccnggnttyaargayytngarccnatggarcarttyathgcncargtngaymgntgygcngaytgyacnacnggntgyytnaarggn
ytngcnaaygtnaartgywsngayytnytnaaraartggytnccncarmgntgygcnacnttygcnwsnaarathcarggncargtngayaa
rathaarggngcnggnggngay
(nucleotide sequence encoding full-length sequence of
*Gaussia princeps* Mutant 1 luciferase with RCAD substitution at $C_5$ and at $C_6$ and with KCSD
substitution at $C_9$);

[SEQ ID NO: 443]

atgggngtnaargtnytnttygcnytnathtgyathgcngtngcngargcnaarccnacngaraayaaygargaytt
yaayathgtngcngtngcnwsnaayttygcnacnacngayytngaygcngaymgnggnaarytnccnggnaaraarytnccnytngargt
nytnaargarytngargcnaaygcnmgnaargcnggntgyacnmgnggntgyytnathtgyytnwsncayathaartgyacnccnaarat
gaaraarttyathccnggnmgntgygcngaytaygarggngayaargarwsngcncarggnggnathggngargcnathgtngayathcc
ngarathccnggnttyaargayytngarccnytngarcarttyathgcncargtngaymgntgygcngaytgyacnacnggntgyytnaarg
gnytngcnaaygtnaartgywsngayytnytnaaraartggytnccncarmgntgygcnacnttygcnwsnaarathcarggncargtngay
aarathaarggngcnggnggngay
(nucleotide sequence encoding full-length sequence of
*Gaussia princeps* Mutant 2 luciferase with RCAD substitution at $C_5$ and with KCSD substitution
at $C_9$);

[SEQ ID NO: 445]

atggargcnaarccnacngaraayaaygargayttyaayathgtngcngtngcnwsnaayttygcnacnacnga
yytngaygcngaymgnggnaarytnccnggnaaraarytnccnytngargtnytnaargaratggargcnaaygcnmgnaargcnggntg
yacnmgnggntgyytnathtgyytnwsncayathaartgyacnccnaaratgaaraarttyathccnggnmgntgygcngaytaygarggn
gayaargarwsngcncarggnggnathggngargcnathgtngayathccngarathccnggnttyaargayytngarccnatggarcartty
athgcncargtngaymgntgygcngaytgyacnacnggntgyytnaarggnytngcnaaygtnaartgywsngayytnytnaaraatggy
tnccncarmgntgygcnacnttygcnwsnaarathcarggncargtngayaarathaarggngcnggnggngay
(nucleotide sequence encoding full-length sequence of *Gaussia princeps* GS luciferase with RCAD
substitution at $C_5$ and at $C_6$ and with KCSD substitution at $C_9$);

[SEQ ID NO: 447]

atgggngtnaarytnathttygcngtnytntgygtngcngcngcncargcngcnacnathaaygaraayttygarg
ayathgaygtngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg
tngayatgccngarathccnggnttyaargayaargarccnatggaycarttyathgcncargtngaymgntgygcngaytgyacnacnggnt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2a luciferase with RCAD substitution at $C_5$ and at $C_6$ and with KCSD
substitution at $C_9$);

[SEQ ID NO: 449]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnytngtngaratggargcnaaygcnaarmgngcnggntgycaymgnggntgyytnathtgyytnwsncayathaartgy
acnaaraaratgaaraarttyathccnggnmgntgygcngaytaygarggngayaargaywsngcncarggnggnathggngargarathg -continued tngayatgccngarathccnggnttyaargayaargarccnatggaycarttyathgcncargtngaymgntgygcngaytgyacnacnggnt
gyytnaarggnytngcnaaygtnaartgywsngayytnytnaaraartggytnccnwsnmgntgyaaracnttygcnwsnaarathcarws
ncargtngayacnathaarggnytngcnggngaymgn
(nucleotide sequence encoding full-
length *Metridia pacifica* 2bv1 luciferase with RCAD substitution at $C_5$ and at $C_6$ and with KCSD substitution at $C_9$);

[SEQ ID NO: 451]

atgggngtnaarytnathttygcngtngtntgygtngcngcngcncargcngcnacnathaaygaraayttygarg
ayathgayytngtngcnathggnggnwsnttygcnytngaygtngaygcnaaymgnggnggncayggnggncayccnggnaaraarat
gccnaargargtnccngtngaratggargcnaaygcnaarmgngcnggntgycaymgnggntgyytnathtgyytnwsncayathaartg
yacnaaraaratgaaraarttyathccnggnmgntgygcngaytaygarggngayaargaywsngcncarggnggnathggngargarath
gtngayatgccngarathccnggnttyaargayaargarccnatggaycarttyathgcncargtngaymgntgygcngaytgyacnacngg
ntgyytnaarggnytngcnaaygtnaartgywsngayytnytnaaraartggytnccnwsnmgntgyaaracnttygcnwsnaarathcar
wsncargtngayacnathaarggnytngcnggngaymgn
(nucleotide sequence encoding full-
length *Metridia pacifica* 2bv2 luciferase with RCAD substitution at $C_5$ and at $C_6$ and with KCSD substitution at $C_9$);

[SEQ ID NO: 453]

atgggngtnaarytnathttygcngtngtntgygtngcngtngcncargcngcnacnathcargaraayttygarga
yathgayytngtngcnathggnggnwsnttygcnwsngaygtngaygcnaaymgnggnggncayggnggncayccnggnaaraaratg
ccnaargargtnytnatggaratggargcnaaygcnaarmgngcnggntgycaymgnggntgyytngtntgyytnwsncayathaartgya
cngcncaratgcaraarttyathccnggnmgntgygcngaytaygcnggngayaargaywsngcncarggnggnathgcnggnggngcn
athgtngayathccngarathgcnggnttyaargaratgaarccnatggarcarttyathgcncargtngaymgntgygcngaytgyacnacn
ggntgyytnaarggnytngcnaaygtnaartgywsngayytnytnaaraartggytnccnwsnmgntgyaaracnttygcnwsnaarathc
arwsncargtngayacnathaarggnytngcnggngaymgn
(nucleotide sequence encoding
full-length *Metridia longa* 22 luciferase with RCAD substitution at $C_5$ and at $C_6$ and with KCSD substitution at $C_9$);

[SEQ ID NO: 455]

atgatggarathcargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v1
luciferase with RCAD substitution at $C_5$ and at $C_6$ and with KCSD substitution at $C_9$);

[SEQ ID NO: 457]

atgatggarathaargtnytnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v2
luciferase with RCAD substitution at $C_5$ and at $C_6$ and with KCSD substitution at $C_9$);

[SEQ ID NO: 459]

atgatggargtnaargtngtnttygcnytnathtgyttygcnytngtncargcnaayccnacngaraayaargayga
yathgayathgtnggngtngarggnaarttyggnacnacngayytngaracngayytnttyacnathgtngargayatgaaygtnathwsnm
gngayacnaayytngcnaaywsngaygcngaymgnggnaaratgccnggnaaraarytnccnytngargtnytnathgaratggargcna
aygcnmgnaargcnggntgyacnmgnggntgyytnathtgyytnwsnaarathaartgyacngcnaaratgaargtntayathccnggnm
gntgygcngaytayggnggngayaaraaracnggncargcnggnathgtnggngcnathgtngayathccngarathwsnggnttyaarga
rytnggnccnatggarcarttyathgcncargtngaymgntgygcngaytgyacnacnggntgyytnaarggnytngcnaaygtnaartgy
wsngayytnytnaaraartggytnccngaymgntgygcnwsnttygcngayaarathcarwsngargtngayaayathaarggnytngcn
ggngaymgn
(nucleotide sequence encoding full-length *Metridia pacifica* 1v3
luciferase with RCAD substitution at $C_5$ and at $C_6$ and with KCSD substitution at $C_9$);

[SEQ ID NO: 461]

atggayathaargtnytnttygcnytnathtgyathgcnytngtncargcnaayccnacngaraayaaygaycaya
thaayathgtnggnathgarggnaarttyggnathacngayytngaracngayytnttyacnathtgggaracnaaymgnatgathwsnacn
gayaaygarcargcnaayacngaywsnaaymgnggnaaratgccnggnaaraarytnccnytngcngtnytnathgaratggargcnaay
gcnttyaargcnggntgyacnmgnggntgyytnathtgyytnwsnaarathaartgyacngcnaaratgaaraartayathccnggnmgntg
ygcngaytayggnggngayaaraaracnggncargcnggnathgtnggngcnathgtngayathccngayathwsnggnttyaargaratg
ggnccnatggarcarttyathgcncargtngaymgntgygcngaytgyacnacnggntgyytnaarggnytngcnaaygtnaartgywsng
ayytnytnaaraartggytnccngaymgntgygcnwsnttygcngayaarathcarwsngargtncayaayathaarggnytngcnggnga
ymgn
(nucleotide sequence encoding full-length *Metridia longa* 39 luciferase with
RCAD substitution at $C_5$ and at $C_6$ and with KCSD substitution at $C_9$);

-continued

[SEQ ID NO: 463]

atggayathaarttyathttygcnytngtntgyathgcnytngtncargcnaayccnacngtnaayaaygaygtnaa
ymgnggnaaratgccnggnaaraarytnccnytngargtnytnathgaratggargcnaaygcnttyaargcnggntgyacnmgnggntgy
ytnathtgyytnwsnaarathaartgyacngcnaaratgaarcartayathccnggnmgntgygcngaytayggnggngayaaraaracngg
ncargcnggnathgtnggngcnathgtngayathccngarathwsnggnttyaargaratggarccnatggarcarttyathgcncargtngay
mgntgygcngaytgyacnacnggntgyytnaarggnytngcnaaygtnaartgywsngayytnytnaaraartggytnccngaymgntgy
gcnwsnttygcngayaarathcaraargargcncayaayathaarggnytngcnggngaymgn
(nucleotide
sequence encoding full-length *Metridia longa* 7 luciferase with RCAD substitution at $C_5$
and at $C_6$ and with KCSD substitution at $C_9$);

[SEQ ID NO: 465]

atgaaracngayathgcngayacngaymgngcnwsnaayttygtngcnacngaracngaygcnaaymgngg
naaratgccnggnaaraarytnccnytngcngtnathatggaratggargcnaaygcnttyaargcnggntgyacnmgnggntgyytnathtg
yytnwsnaarathaartgyacngcnaaratgaargtntayathccnggnmgntgygcngaytayggnggngayaaraaracnggncargcn
ggnathgtnggngcnathgtngayathccngarathwsnggnttyaargaratggcnccnatggarcarttyathgcncargtngaymgntgy
gcngaytgyacnacnggntgyytnaarggnytngcnaaygtnaartgywsngayytnytnaaraartggytnccngaymgntgygcnwsn
ttygcngayaarathcaraargargtncayaayathaarggnatggcnggngaymgn
(nucleotide
sequence encoding full-length *Metridia longa* GS luciferase with RCAD substitution at $C_5$ and at
$C_6$ and with KCSD substitution at $C_9$);

[SEQ ID NO: 467]

atggayathaargtngtnttyacnytngtnttywsngcnytngtncargcncaraaracngayathgcngayacng
aymgngcnwsnaayttygtngcnacngaracngaygcnaaymgnggnaaratgccnggnaaraarytnccnytngcngtnathatggara
tggargcnaaygcnttyaargcnggntgyacnmgnggntgyytnathtgyytnwsnaarathaartgyacngcnaaratgaargtntayathc
cnggnmgntgygcngaytayggnggngayaaraaracnggncargcnggnathgtnggngcnathgtngayathccngarathwsnggn
ttyaargaratggcnccnatggarcarttyathgcncargtngaymgntgygcngaytgyacnacnggntgyytnaarggnytngcnaaygtn
aartgywsngayytnytnaaraartggytnccngaymgntgygcnwsnttygcngayaarathcaraargargtncayaayathaarggnat
ggcnggngaymgn
(nucleotide sequence encoding full-length *Metridia longa* 164M3
luciferase with RCAD substitution at $C_5$ and at $C_6$ and with KCSD substitution at $C_9$);

[SEQ ID NO: 469]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngaymgntgygcngaytgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v1 luciferase with RCAD substitution at $C_5$ and at $C_6$ and with KCSD
substitution at $C_9$);

[SEQ ID NO: 471]

atggayathaargtngtnttyacnytngtnttywsngcnytngtncargcnaarwsnacngarttygayccnaayat
hgayathgtnggnytngarggnaarttyggnathacnaayytngaracngayytnttyacnathtgggaracnatggargtnatgathaargcn
gayathgcngayacngaymgngcnwsnaayttygtngcnacngaracngaygcnaaymgnggnaaratgccnggnaaraarytnccnyt
ngcngtnathatggaratggargcnaaygcnttyaargcnggntgyacnmgnggntgyytnathtgyytnwsnaarathaartgyacngcna
aratgaargtntayathccnggnmgntgygcngaytayggnggngayaaraaracnggncargcnggnathgtnggngcnathgtngayat
hccngarathwsnggnttyaargaratggcnccnatggarcarttyathgcncargtngarmgntgygcngaytgyacnacnggntgyytna
arggnytngcnaaygtnaartgywsngayytnytnaaraartggytnccngaymgntgygcnwsnttygcngayaarathcaraargargtn
cayaayathaarggnatggcnggngaymgn
(nucleotide sequence encoding full-length
*Metridia longa* 164v2 luciferase with RCAD substitution at $C_5$ and at $C_6$ and with KCSD
substitution at $C_9$);

[SEQ ID NO: 473]

atggayatgaargtnathttygcnytnathttywsngcnytngtncargcnaarwsnacngarttygayccnaayat
hgayathgtnggnytngarggnaarttyggnathacnaayytngaracngayytnttyacnathtgggaracnatggargtnathaarwsnga
yathgcngayacngaymgngtnwsnaayttygtngcnacngaracngaygcnaaymgnggnaaratgccnggnaaraarytnccnytng
cngtnathatggaratggargcnaaygcnttyaargcnggntgyacnmgnggntgyytnathtgyytnwsnaarathaartgyacngcnaar
atgaargtntayathccnggnmgntgygcngaytayggnggngayaaraaracnggncargcnggnathgtnggngcnathgtngayathc
cngarathwsnggnttyaargaratggcnccnatggarcarttyathgcncargtngaymgntgygcngaytgyacnacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 16 luciferase with RCAD substitution at $C_5$ and at $C_6$ and with KCSD substitution
at $C_9$);

[SEQ ID NO: 475]

atggayathaargtngtnttygcnytngtnttywsngcnytngtncargcnaarwsnacngarttygayccnaaya
thgayathgtnggnytngarggnaarttyggnathacnaayytngaracngayytnttyacnathtgggaracnatggargtnathaaracnga
yathgcngayacngaymgngcnmgnwsnttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath -continued ccngarathwsnggnttyaargaratggarccnatggarcarttyathgcncargtngaymgntgygcngaytgyacnacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 45 luciferase with RCAD substitution at $C_5$ and at $C_6$ and with KCSD substitution
at $C_9$);

[SEQ ID NO: 477]

atggayathaargtngtnttygcnytngtnttywsngcnytngtncargcnaarwsnacngarttygayccnaaya
thgaygtngtnggnytngarggnaarttyggnathacnaayytngaracngayytnttyacnathtgggaracnatggargtnathaaracnga
yathgcngayacngaymgngcnmgnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggarccnatggarcarttyathgcncargtngaymgntgygcngaytgyaayacnggntgyytnaar
ggnytngcnaaygtnaartgywsngayytnytnaaraartggytnccngaymgntgygcnwsnttygcngayaarathcaraargargtnca
yaayathaarggnatggcnggngaymgn
(nucleotide sequence encoding full-length
*Metridia longa* 52 luciferase with RCAD substitution at $C_5$ and at $C_6$ and with KCSD substitution
at $C_9$),or

[SEQ ID NO: 479]

atggayatgmgngtnathttygcnytngtnttywsnwsnytngtncargcnaarwsnacngarttygayccnaay
athaayathgtnggnytngarggnaarttyggnathacnaayytngaracngayytnttyacnathtgggaracnatggaygtnathaarwsng
ayathacngayacngaymgngtnwsnaayttygtngcnacngaracngaygcnaaymgnggnaaratgccnggnaaraarytnccnytn
gcngtnathatggaratggargcnaaygcnttyaargcnggntgyacnmgnggntgyytnathtgyytnwsnaarathaartgyacngcnaa
ratgaargtntayathccnggnmgntgygcngaytayggnggngayaaraaracnggncargcnggnathgtnggngcnathgtngayath
ccngarathwsnggnttyaargaratggcnccnatggarcarttyathgcncargtngaymgntgygcngaytgyacnacnggntgyytnaa
rggnytngcnaaygnaartgywsngayytnytnaaraartggytnccnggnmgntgygcnwsnttygcngayaarathcaraargargtnc
ayaayathaarggnatggcnggngaymgn
(nucleotide sequence encoding full-length
*Metridia longa* AL luciferase with RCAD substitution at $C_5$ and at $C_6$ and with KCSD substitution
at $C_9$) or a complement thereof;

(d) an amino acid sequence which is encoded by a nucleotide sequence that shares at least 70% (and at least 71% to at least 99% and all integer percentages in between) sequence identity with the sequence set forth in any one of SEQ ID NO: 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477 or 479, or a complement thereof, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above; or (e) an amino acid sequence which is encoded by a nucleotide sequence that hybridizes under at least medium or high stringency conditions to the sequence set forth in any one of SEQ ID NO: 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477 or 479, or a complement thereof, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above.

In other embodiments, the polypeptides according to formula X comprise, consist or consist essentially of an amino acid sequence selected from the group consisting of:

(a) an amino acid sequence selected from:

[SEQ ID NO: 482]

DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANVQ
CSDLLKKWLPQRCATFASKIQGQVDKIKGAGGD
(intracellular *Gaussia princeps* Prolume luciferase with RCAD
substitution at $C_5$);

[SEQ ID NO: 484]

DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANVQ
CSDLLKKWLPQRCATFASKIQGQVDKIKGAGGDKDEL
(intracellular *Gaussia princeps* Prolume KDEL luciferase with RCAD
substitution at $C_5$);

-continued

[SEQ ID NO: 486]
DLDADRGKLPGKKLPLEVLKEIEANARKAGCTRGCLICLSHIKCTPKMKKF
IPGRCADYEGDKESAQGGIGEAIVDIPEIPGFKDLEPMEQFIAQVDLCVDCTTGCLKGLANVQ
CSDLLKKWLPQRCATFASKIQGQVDKIKGAGGD
(intracellular *Gaussia princeps* Mutant 1 luciferase with RCAD substitution at $C_5$);

[SEQ ID NO: 488]
DLDADRGKLPGKKLPLEVLKELEANARKAGCTRGCLICLSHIKCTPKMKK
FIPGRCADYEGDKESAQGGIGEAIVDIPEIPGFKDLEPLEQFIAQVDLCVDCTTGCLKGLANVQ
CSDLLKKWLPQRCATFASKIQGQVDKIKGAGGD
(intracellular *Gaussia princeps* Mutant 2 luciferase with RCAD substitution at $C_5$);

[SEQ ID NO: 490]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANVQ
CSDLLKKWLPQRCATFASKIQGQVDKIKGAGGD
(intracellular *Gaussia princeps* GS luciferase with RCAD substitution at $C_5$);

[SEQ ID NO: 492]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVHCSALLKKWLPSRCKTFASKIQSQVDTIKGLAGDR
(intracellular *Metridia pacifica* 2a luciferase with RCAD substitution at $C_5$);

[SEQ ID NO: 494]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVHCSDLLKKWLPSRCKTFASKIQSQVDTIKGLAGDR
(intracellular *Metridia pacifica* 2bv1 luciferase with RCAD substitution at $C_5$);

[SEQ ID NO: 496]
DVDANRGGHGGHPGKKMPKEVPVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVHCSDLLKKWLPSRCKTFASKIQSQVDTIKGLAGDR
(intracellular *Metridia pacifica* 2bv2 luciferase with RCAD substitution at $C_5$);

[SEQ ID NO: 498]
DVDANRGGHGGHPGKKMPKEVLMEMEANAKRAGCHRGCLVCLSHIKCT
AQMQKFIPGRCADYAGDKDSAQGGIAGGAIVDIPEIAGFKEMKPMEQFIAQVDLCEDCTTGC
LKGLANVHCSDLLKKWLPSRCKTFASKIQSQVDTIKGLAGDR
(intracellular *Metridia longa* 22 luciferase with RCAD substitution at $C_5$);

[SEQ ID NO: 500]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(intracellular *Metridia pacifica* 1v1 luciferase with RCAD substitution at $C_5$);

[SEQ ID NO: 502]
NSDADRGKMPGKKLPLEVLIEMEANARKAGCTRGCLICLSKIKCTAKMKV
YlPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(intracellular *Metridia pacifica* 1v2 luciferase with RCAD substitution at $C_5$);

[SEQ ID NO: 504]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSALLKKWLPDRCASFADKIQSEVDNIKGLAGDR
(intracellular *Metridia pacifica* 1v3 luciferase with RCAD substitution at $C_5$);

[SEQ ID NO: 506]
NTDSNRGKMPGKKLPLAVLIEMEANAFKAGCTRGCLICLSKIKCTAKMKK
YIPGRCADYGGDKKTGQAGIVGAIVDIPDISGFKEMGPMEQFIAQVDRCTDCTTGCLKGLAN
VKCSELLKKWLPDRCASFADKIQSEVHNIKGLAGDR
(intracellular *Metridia longa* 39 luciferase with RCAD substitution at $C_5$);

-continued

[SEQ ID NO: 508]
NNDVNRGKMPGKKLPLEVLIEMEANAFKAGCTRGCLICLSKIKCTAKMKQ
YIPGRCADYGGDKKTGQAGIVGAIVDIPEISGFKEMEPMEQFIAQVDLCADCTTGCLKGLANV
KCSELLKKWLPDRCASFADKIQKEAHNIKGLAGDR
(intracellular *Metridia longa* 7 luciferase with RCAD substitution at $C_5$);

[SEQ ID NO: 510]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSELLKKWLPDRCASFADKIQKEVHNIKGMAGDR
(intracellular *Metridia longa* GS luciferase with RCAD substitution at $C_5$);

[SEQ ID NO: 512]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSELLKKWLPDRCASFADKIQKEVHNIKGMAGDR
(intracellular *Metridia longa* 164M3 luciferase with RCAD substitution at $C_5$);

[SEQ ID NO: 514]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSELLKKWLPDRCASFADKIQKEVHNIKGMAGDR
(intracellular *Metridia longa* 164v1 luciferase with RCAD substitution at $C_5$);

[SEQ ID NO: 516]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVERCASCTTGCLKGLAN
VKCSELLKKWLPDRCASFADKIQKEVHNIKGMAGDR
(intracellular *Metridia longa* 164v2 luciferase with RCAD substitution at $C_5$);

[SEQ ID NO: 518]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCTSCTTGCLKGLAN
VKCSELLKKWLPDRCASFADKIQKEVHNIKGMAGDR
(intracellular *Metridia longa* 16 luciferase with RCAD substitution at $C_5$);

[SEQ ID NO: 520]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCASCTTGCLKGLAN
VKCSELLKKWLPDRCASFADKIQKEVHNIKGMAGDR
(intracellular *Metridia longa* 45 luciferase with RCAD substitution at $C_5$);

[SEQ ID NO: 522]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCASCNTGCLKGLAN
VKCSELLKKWLPDRCASFADKIQKEVHNIKGMAGDR
(intracellular *Metridia longa* 52 luciferase with RCAD substitution at $C_5$);
and

[SEQ ID NO: 524]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDLCATCTTGCLKGLAN
VKCSELLKKWLPGRCASFADKIQKEVHNIKGMAGDR
(intracellular *Metridia longa* AL luciferase with RCAD substitution at $C_5$);

[SEQ ID NO: 526]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANVQ
CSDLLKKWLPQRCATFASKIQGQVDKIKGAGGD
(intracellular *Gaussia princeps* Prolume luciferase with RCAD substitution at $C_6$);

[SEQ ID NO: 528]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANVQ
CSDLLKKWLPQRCATFASKIQGQVDKIKGAGGDKDEL
(intracellular *Gaussia princeps* Prolume KDEL luciferase with RCAD substitution at $C_6$);

-continued

[SEQ ID NO: 530]
DLDADRGKLPGKKLPLEVLKEIEANARKAGCTRGCLICLSHIKCTPKMKKF
IPGRCHTYEGDKESAQGGIGEAIVDIPEIPGFKDLEPMEQFIAQVDRCADCTTGCLKGLANVQ
CSDLLKKWLPQRCATFASKIQGQVDKIKGAGGD
(intracellular *Gaussia princeps* Mutant 1 luciferase with RCAD substitution at $C_6$);

[SEQ ID NO: 532]
DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDRCADCTTGCLKGLANVQ
CSDLLKKWLPQRCATFASKIQGQVDKIKGAGGD
(intracellular *Gaussia princeps* Mutant 2 luciferase with RCAD substitution at $C_6$);

[SEQ ID NO: 534]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANVQ
CSDLLKKWLPQRCATFASKIQGQVDKIKGAGGD
(intracellular *Gaussia princeps* GS luciferase with RCAD substitution at $C_6$)

[SEQ ID NO: 536]
DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDRCADCTTGCLK
GLANVHCSALLKKWLPSRCKTFASKIQSQVDTIKGLAGDR
(intracellular *Metridia pacifica* 2a luciferase with RCAD substitution at $C_6$);

[SEQ ID NO: 538]
DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDRCADCTTGCLK
GLANVHCSDLLKKWLPSRCKTFASKIQSQVDTIKGLAGDR
(intracellular *Metridia pacifica* 2bv1 luciferase with RCAD substitution at $C_6$);

[SEQ ID NO: 540]
DVDANRGGHGGHPGKKMPKEVPVEMEANAKRAGCHRGCLICLSHIKCTK
KMKKFIPGRCHSYEGDKDSAQGGIGEEIVDMPEIPGFKDKEPMDQFIAQVDRCADCTTGCLK
GLANVHCSDLLKKWLPSRCKTFASKIQSQVDTIKGLAGDR
(intracellular *Metridia pacifica* 2bv2 luciferase with RCAD substitution at $C_6$);

[SEQ ID NO: 542]
DVDANRGGHGGHPGKKMPKEVLMEMEANAKRAGCHRGCLVCLSHIKCT
AQMQKFIPGRCHSYAGDKDSAQGGIAGGAIVDIPEIAGFKEMKPMEQFIAQVDRCADCTTGC
LKGLANVHCSDLLKKWLPSRCKTFASKIQSQVDTIKGLAGDR
(intracellular *Metridia longa* 22 luciferase with RCAD substitution at $C_6$);

[SEQ ID NO: 544]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v1 luciferase with RCAD substitution at $C_6$);

[SEQ ID NO: 546]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v2 luciferase with RCAD substitution at $C_6$);

[SEQ ID NO: 548]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v3 luciferase with RCAD substitution at $C_6$);

[SEQ ID NO: 550]
NTDSNRGKMPGKKLPLAVLIEMEANAFKAGCTRGCLICLSKIKCTAKMKK
YIPGRCHDYGGDKKTGQAGIVGAIVDIPDISGFKEMGPMEQFIAQVDRCADCTTGCLKGLAN
VKCSELLKKWLPDRCASFADKIQSEVHNIKGLAGDR
(intracellular *Metridia longa* 39 luciferase with RCAD substitution at $C_6$);

-continued

[SEQ ID NO: 552]
NNDVNRGKMPGKKLPLEVLIEMEANAFKAGCTRGCLICLSKIKCTAKMKQ
YIPGRCHDYGGDKKTGQAGTVGAIVDIPEISGFKEMEPMEQFIAQVDRCADCTTGCLKGLAN
VKCSELLKKWLPDRCASFADKIQKEAHNIKGLAGDR
(intracellular *Metridia longa* 7 luciferase with RCAD substitution at $C_6$);

[SEQ ID NO: 554]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* GS luciferase with RCAD substitution at $C_6$);

[SEQ ID NO: 556]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 164M3 luciferase with RCAD substitution at $C_6$);

[SEQ ID NO: 558]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 164v1 luciferase with RCAD substitution at $C_6$);

[SEQ ID NO: 560]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVERCADCTTGCLKGLA
NVKCSELLKKWLPDRCASFADKIQKEVHNIKGMAGDR
(intracellular *Metridia longa* 164v2 luciferase with RCAD substitution at $C_6$);

[SEQ ID NO: 562]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 16 luciferase with RCAD substitution at $C_6$);

[SEQ ID NO: 564]
ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCADCTTGCLKGLA
NVKCSELLKKWLPDRCASFADKIQKEVHNIKGMAGDR
(intracellular *Metridia longa* 45 luciferase with RCAD substitution at $C_6$);

[SEQ ID NO: 566]
ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCADCNTGCLKGLA
NVKCSELLKKWLPDRCASFADKIQKEVHNIKGMAGDR
(intracellular *Metridia longa* 52 luciferase with RCAD substitution at $C_6$);

[SEQ ID NO: 568]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSELLKKWLPGRCASFADKIQKEVHNIKGMAGDR
(intracellular *Metridia longa* AL luciferase with RCAD substitution at $C_6$);

[SEQ ID NO: 570]
DLDADRGKLPGKKLPLEVLKEMEANARKAGCTRGCLICLSHIKCTPKMKK
FIPGRCHTYEGDKESAQGGIGEAIVDIPEIPGFKDLEPMEQPIAQVDLCVDCTTGCLKGLANV
KCSDLLKKWLPQRCATFASKIQGQVDKIKGAGGD
(intracellular *Gaussia princeps* Prolume luciferase with KCSD substitution at $C_9$);

[SEQ ID NO: 572]
DLDADRGKLPGKKLPLEVLKEMEANARKAGCTRGCLICLSHIKCTPKMKK
FIPGRCHTYEGDKESAQGGIGEAIVDIPEIPGFKDLEPMEQPIAQVDLCVDCTTGCLKGLANV
KCSDLLKKWLPQRCATFASKIQGQVDKIKGAGGDKDEL
(intracellular *Gaussia princeps* Prolume KDEL luciferase with KCSD substitution at $C_9$);

-continued

[SEQ ID NO: 574]
DLDADRGKLPGKKLPLEVLKEIEANARKAGCTRGCLICLSHIKCTPKMKKF
IPGRCHTYEGDKESAQGGIGEAIVDIPEIPGFKDLEPMEQFIAQVDLCVDCTTGCLKGLANV
KCSDLLKKWLPQRCATFASKIQGQVDKIKGAGGD
(intracellular *Gaussia princeps* Mutant 1 luciferase with KCSD substitution at $C_9$);

[SEQ ID NO: 576]
DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDLCVDCTTGCLKGLANV
KCSDLLKKWLPQRCATFASKIQGQVDKIKGAGGD
(intracellular *Gaussia princeps* Mutant 2 luciferase with KCSD substitution at $C_9$);

[SEQ ID NO: 578]
DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDLCVDCTTGCLKGLANV
KCSDLLKKWLPQRCATFASKIQGQVDKIKGAGGD
(intracellular *Gaussia princeps* GS luciferase with KCSD substitution at $C_9$)

[SEQ ID NO: 580]
DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2a luciferase with KCSD substitution at $C_9$);

[SEQ ID NO: 582]
DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2bv1 luciferase with KCSD substitution at $C_9$);

[SEQ ID NO: 584]
DVDANRGGHGGHPGKKMPKEVPVEMEANAKRAGCHRGCLICLSHIKCTK
KMKKFIPGRCHSYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2bv2 luciferase with KCSD substitution at $C_9$);

[SEQ ID NO: 586]
DVDANRGGHGGHPGKKMPKEVLMEMEANAKRAGCHRGCLVCLSHIKCT
AQMQKFIPGRCHSYAGDKDSAQGGIAGGAIVDIPEIAGFKEMKPMEQFIAQVDLCEDCTTGCL
KGLANVKCSDLLKKWLPSRCKTFASKIQSQVDTIKGLAGDR
(intracellular *Metridia longa* 22 luciferase with KCSD substitution at $C_9$);

[SEQ ID NO: 588]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v1 luciferase with KCSD substitution at $C_9$);

[SEQ ID NO: 590]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v2 luciferase with KCSD substitution at $C_9$);

[SEQ ID NO: 592]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v3 luciferase with KCSD substitution at $C_9$);

[SEQ ID NO: 594]
NTDSNRGKMPGKKLPLAVLIEMEANAFKAGCTRGCLICLSKIKCTAKMKK
YIPGRCHDYGGDKKTGQAGIVGAIVDIPDISGFKEMGPMEQFIAQVDRCTDCTTGCLKGLAN
VKCSDLLKKWLPDRCASFADKIQSEVHNIKGLAGDR
(intracellular *Metridia longa* 39 luciferase with KCSD substitution at $C_9$);

-continued

[SEQ ID NO: 596]
NNDVNRGKMPGKKLPLEVLIEMEANAFKAGCTRGCLICLSKIKCTAKMKQ
YIPGRCHDYGGDKKTGQAGIVGAIVDIPEISGFKEMEPMEQFIAQVDLCADCTTGCLKGLANV
KCSDLLKKWLPDRCASFADKIQKEAHNIKGLAGDR
(intracellular *Metridia longa* 7 luciferase with KCSD substitution at $C_9$);

[SEQ ID NO: 598]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* GS luciferase with KCSD substitution at $C_9$);

[SEQ ID NO: 600]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* 164M3 luciferase with KCSD substitution at $C_9$);

[SEQ ID NO: 602]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* 164v1 luciferase with KCSD substitution at $C_9$);

[SEQ ID NO: 604]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVERCASCTTGCLKGLAN
VKCSDLLKKWLPDRCASFADKIQKEVHNIKGMAGDR
(intracellular *Metridia longa* 164v2 luciferase with KCSD substitution at $C_9$);

[SEQ ID NO: 606]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCTSCTTGCLKGLAN
VKCSDLLKKWLPDRCASFADKIQKEVHNIKGMAGDR
(intracellular *Metridia longa* 16 luciferase with KCSD substitution at $C_9$);

[SEQ ID NO: 608]
ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCASCTTGCLKGLAN
VKCSDLLKKWLPDRCASFADKIQKEVHNIKGMAGDR
(intracellular *Metridia longa* 45 luciferase with KCSD substitution at $C_9$);

[SEQ ID NO: 610]
ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCASCNTGCLKGLAN
VKCSDLLKKWLPDRCASFADKIQKEVHNIKGMAGDR
(intracellular *Metridia longa* 52 luciferase with KCSD substitution at $C_9$);

[SEQ ID NO: 612]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDLCATCTTGCLKGLAN
VKCSDLLKKWLPGRCASFADKIQKEVHNIKGMAGDR
(intracellular *Metridia longa* AL luciferase with KCSD substitution at $C_9$);

[SEQ ID NO: 614]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDRCADCTTGCLKGLANV
QCSDLLKKWLPQRCATFASKIQGQVDKIKGAGGD
(intracellular *Gaussia princeps* Prolume luciferase with RCAD substitution at $C_5$ and at $C_6$);

[SEQ ID NO: 616]
DLDADRGKLPGKKLPLEVLKEIEANARKAGCTRGCLICLSHIKCTPKMKK
FIPGRCADYEGDKESAQGGIGEAIVDIPEIPGFKDLEPLEQFIAQVDRCADCTTGCLKGLANV
QCSDLLKKWLPQRCATFASKIQGQVDKIKGAGGDKDEL
(intracellular *Gaussia princeps* Prolume KDEL luciferase with RCAD substitution at $C_5$ and at $C_6$);

-continued

[SEQ ID NO: 618]
DLDADRGKLPGKKLPLEVLKEIEANARKAGCTRGCLICLSHIKCTPKMKKF
IPGRCADYEGDKESAQGGIGEAIVDIPEIPGFKDLEPMEQFIAQVDRCADCTTGCLKGLANVQ
CSDLLKKWLPQRCATFASKIQGQVDKIKGAGGD
(intracellular *Gaussia princeps* Mutant 1 luciferase with RCAD substitution at $C_5$ and at $C_6$);

[SEQ ID NO: 620]
DLDADRGKLPGKKLPLEVLKELEANARKAGCTRGCLICLSHIKCTPKMKK
FIPGRCADYEGDKESAQGGIGEAIVDIPEIPGFKDLEPLEQFIAQVDRCADCTTGCLKGLANVQ
CSDLLKKWLPQRCATFASKIQGQVDKIKGAGGD
(intracellular *Gaussia princeps* Mutant 2 luciferase with RCAD substitution at $C_5$);

[SEQ ID NO: 622]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDRCADCTTGCLKGLANV
QCSDLLKKWLPQRCATFASKIQGQVDKIKGAGGD
(intracellular *Gaussia princeps* GS luciferase with RCAD substitution at $C_5$ and at $C_6$);

[SEQ ID NO: 624]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDRCADCTTGCLK
GLANVHCSALLKKWLPSRCKTFASKIQSQVDTIKGLAGDR
(intracellular *Metridia pacifica* 2a luciferase with RCAD substitution at $C_5$ and at $C_6$);

[SEQ ID NO: 626]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDRCADCTTGCLK
GLANVHCSDLLKKWLPSRCKTFASKIQSQVDTIKGLAGDR
(intracellular *Metridia pacifica* 2bv1 luciferase with RCAD substitution at $C_5$ and at $C_6$);

[SEQ ID NO: 628]
DVDANRGGHGGHPGKKMPKEVPVEMEANAKRAGCHRGCLICLSHIKCTK
KMKKCFIPGRCADYEGDKDSAQGGIGEEIVDMPEIPGFKDKEPMDQFIAQVDRCADCTTGCLK
GLANVHCSDLLKKWLPSRCKTFASKIQSQVDTIKGLAGDR
(intracellular *Metridia pacifica* 2bv2 luciferase with RCAD substitution at $C_5$ and at $C_6$);

[SEQ ID NO: 630]
DVDANRGGHGGHPGKKMPKEVLMEMEANAKRAGCHRGCLVCLSHIKCT
AQMQKFIPGRCADYAGDKDSAQGGIAGGAIVDIPEIAGFKEMKPMEQFIAQVDRCADCTTGC
LKGLANVHCSDLLKKWLPSRCKTFASKIQSQVDTIKGLAGDR
(intracellular *Metridia longa* 22 luciferase with RCAD substitution at $C_5$ and at $C_6$);

[SEQ ID NO: 632]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v1 luciferase with RCAD substitution at $C_5$ and at $C_6$);

[SEQ ID NO: 634]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v2 luciferase with RCAD substitution at $C_5$ and at $C_6$);

[SEQ ID NO: 636]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSALLKKWLPDRCASFADKIQSEVDNIKGLAGDR
(intracellular *Metridia pacifica* 1v3 luciferase with RCAD substitution at $C_5$ and at $C_6$);

[SEQ ID NO: 638]
NTDSNRGKMPGKKLPLAVLIEMEANAFKAGCTRGCLICLSKIKCTAKMKK
YIPGRCADYGGDKKTGQAGIVGAIVDIPDISGFKEMGPMEQFIAQVDRCADCTTGCLKGLAN
VKCSELLKKWLPDRCASFADKIQSEVHNIKGLAGDR
(intracellular *Metridia longa* 39 luciferase with RCAD substitution at $C_5$ and at $C_6$);

-continued

[SEQ ID NO: 640]
NNDVNRGKMPGKKLPLEVLIEMEANAFKAGCTRGCLICLSKIKCTAKMKQ
YIPGRCADYGGDKKTGQAGIVGAIVDIPEISGFKEMEPMEQFIAQVDRCADCTTGCLKGLAN
VKCSELLKKWLPDRCASFADKIQKEAHNIKGLAGDR
(intracellular *Metridia longa* 7 luciferase with RCAD substitution at $C_5$ and at $C_6$);

[SEQ ID NO: 642]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* GS luciferase with RCAD substitution at $C_5$ and at $C_6$);

[SEQ ID NO: 644]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 164M3 luciferase with RCAD substitution at $C_5$ and at $C_6$);

[SEQ ID NO: 646]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 164v1 luciferase with RCAD substitution at $C_5$ and at $C_6$);

[SEQ ID NO: 648]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVERCADCTTGCLKGLA
NVKCSELLKKWLPDRCASFADKIQKEVHNIKGMAGDR
(intracellular *Metridia longa* 164v2 luciferase with RCAD substitution at $C_5$ and at $C_6$);

[SEQ ID NO: 650]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSELLKKWLPDRCASFADKIQKEVHNIKGMAGDR
(intracellular *Metridia longa* 16 luciferase with RCAD substitution at $C_5$ and at $C_6$);

[SEQ ID NO: 652]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCADCTTGCLKGLA
NVKCSELLKKWLPDRCASFADKIQKEVHNIKGMAGDR
(intracellular *Metridia longa* 45 luciferase with RCAD substitution at $C_5$ and at $C_6$);

[SEQ ID NO: 654]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCADCNTGCLKGLA
NVKCSELLKKWLPDRCASFADKIQKEVHNIKGMAGDR
(intracellular *Metridia longa* 52 luciferase with RCAD substitution at $C_5$ and at $C_6$);

[SEQ ID NO: 656]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSELLKKWLPGRCASFADKIQKEVHNIKGMAGDR
(intracellular *Metridia longa* AL luciferase with RCAD substitution at $C_5$ and at $C_6$);

[SEQ ID NO: 658]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANV
KCSDLLKKWLPQRCATFASKIQGQVDKIKGAGGD
(intracellular *Gaussia princeps* Prolume luciferase with RCAD substitution at $C_5$ and with KCSD substitution at $C_9$);

[SEQ ID NO: 660]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANV
KCSDLLKKWLPQRCATFASKIQGQVDKIKGAGGDKDEL
(intracellular *Gaussia princeps* Prolume KDEL luciferase with RCAD substitution at $C_5$ and with KCSD substitution at $C_9$)
;

-continued

[SEQ ID NO: 662]
DLDADRGKLPGKKLPLEVLKEIEANARKAGCTRGCLICLSHIKCTPKMKKF
IPGRCADYEGDKESAQGGIGEAIVDIPEIPGFKDLEPMEQFIAQVDLCVDCTTGCLKGLANV
KCSDLLKKWLPQRCATFASKIQGQVDKIKGAGGD
(intracellular *Gaussia princeps* Mutant 1 luciferase with RCAD substitution at $C_5$ and with KCSD substitution at $C_9$);

[SEQ ID NO: 664]
DLDADRGKLPGKKLPLEVLKELEANARKAGCTRGCLICLSHIKCTPKMKK
FIPGRCADYEGDKESAQGGIGEAIVDIPEIPGFKDLEPLEQFIAQVDLCVDCTTGCLKGLANV
KCSDLLKKWLPQRCATFASKIQGQVDKIKGAGGD
(intracellular *Gaussia princeps* Mutant 2 luciferase with RCAD substitution at $C_5$ and with KCSD substitution at $C_9$);

[SEQ ID NO: 666]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDLCVDCTTGCLKGLANV
KCSDLLKKWLPQRCATFASKIQGQVDKIKGAGGD
(intracellular *Gaussia princeps* GS luciferase with RCAD substitution at $C_5$ and with KCSD substitution at $C_9$);

[SEQ ID NO: 668]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2a luciferase with RCAD substitution at $C_5$ and with KCSD substitution at $C_9$);

[SEQ ID NO: 670]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2bv1 luciferase with RCAD substitution at $C_5$ and with KCSD substitution at $C_9$);

[SEQ ID NO: 672]
DVDANRGGHGGHPGKKMPKEVPVEMEANAKRAGCHRGCLICLSHIKCTK
KMKKFIPGRCADYEGDKDSAQGGIGEEIVDMPEIPGFKDKEPMDQFIAQVDLCVDCTTGCLK
GLANVKCSDLLKKWLPSRCKTFASKIQSQVDTIKGLAGDR
(intracellular *Metridia pacifica* 2bv2 luciferase with RCAD substitution at $C_5$ and with KCSD substitution at $C_9$);

[SEQ ID NO: 674]
DVDANRGGHGGHPGKKMPKEVLMEMEANAKRAGCHRGCLVCLSHIKCT
AQMQKFIPGRCADYAGDKDSAQGGIAGGAIVDIPEIAGFKEMKPMEQFIAQVDLCEDCTTGC
LKGLANVKCSDLLKKWLPSRCKTFASKIQSQVDTIKGLAGDR
(intracellular *Metridia longa* 22 luciferase with RCAD substitution at $C_5$ and with KCSD substitution at $C_9$);

[SEQ ID NO: 676]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v1 luciferase with RCAD substitution at $C_5$ and with KCSD substitution at $C_9$);

[SEQ ID NO: 678]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v2 luciferase with RCAD substitution at $C_5$ and with KCSD substitution at $C_9$);

[SEQ ID NO: 680]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDLCADCTTGCLKGLANV
KCSDLLKKWLPDRCASFADKIQSEVDNIKGLAGDR
(intracellular *Metridia pacifica* 1v3 luciferase with RCAD substitution at $C_5$ and with KCSD substitution at $C_9$);

[SEQ ID NO: 682]
NTDSNRGKMPGKKLPLAVLIEMEANAFKAGCTRGCLICLSKIKCTAKMKK
YIPGRCADYGGDKKTGQAGIVGAIVDIPDISGFKEMGPMEQFIAQVDRCTDCTTGCLKGLAN
VKCSDLLKKWLPDRCASFADKIQSEVHNIKGLAGDR
(intracellular *Metridia longa* 39 luciferase with RCAD substitution at $C_5$ and with KCSD substitution at $C_9$)
;

-continued

[SEQ ID NO: 684]
NNDVNRGKMPGKKLPLEVLIEMEANAFKAGCTRGCLICLSKIKCTAKMKQ
YIPGRCADYGGDKKTGQAGIVGAIVDIPEISGFKEMEPMEQFIAQVDLCADCTTGCLKGLANV
KCSDLLKKWLPDRCASFADKIQKEAHNIKGLAGDR
(intracellular *Metridia longa* 7 luciferase with RCAD substitution at $C_5$ and with KCSD substitution at $C_9$);

[SEQ ID NO: 686]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* GS luciferase with RCAD substitution at $C_5$ and with KCSD substitution at $C_9$);

[SEQ ID NO: 688]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* 164M3 luciferase with RCAD substitution at $C_5$ and with KCSD substitution at $C_9$);

[SEQ ID NO: 690]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCASCTTGCLKGLAN
VKCSDLLKKWLPDRCASFADKIQKEVHNIKGMAGDR
(intracellular *Metridia longa* 164v1 luciferase with RCAD substitution at $C_5$ and with KCSD substitution at $C_9$);

[SEQ ID NO: 692]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVERCASCTTGCLKGLAN
VKCSDLLKKWLPDRCASFADKIQKEVHNIKGMAGDR
(intracellular *Metridia longa* 164v2 luciferase with RCAD substitution at $C_5$ and with KCSD substitution at $C_9$);

[SEQ ID NO: 694]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCTSCTTGCLKGLAN
VKCSDLLKKWLPDRCASFADKIQKEVHNIKGMAGDR
(intracellular *Metridia longa* 16 luciferase with RCAD substitution at $C_5$ and with KCSD substitution at $C_9$);

[SEQ ID NO: 696]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCASCTTGCLKGLAN
VKCSDLLKKWLPDRCASFADKIQKEVHNIKGMAGDR
(intracellular *Metridia longa* 45 luciferase with RCAD substitution at $C_5$ and with KCSD substitution at $C_9$);

[SEQ ID NO: 698]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCASCNTGCLKGLAN
VKCSDLLKKWLPDRCASFADKIQKEVHNIKGMAGDR
(intracellular *Metridia longa* 52 luciferase with RCAD substitution at $C_5$ and with KCSD substitution at $C_9$);
and

[SEQ ID NO: 700]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDLCATCTTGCLKGLAN
VKCSDLLKKWLPGRCASFADKIQKEVHNIKGMAGDR
(intracellular *Metridia longa* AL luciferase with RCAD substitution at $C_5$ and with KCSD substitution at $C_9$);

[SEQ ID NO: 702]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANV
KCSDLLKKWLPQRCATFASKIQGQVDKIKGAGGD
(intracellular *Gaussia princeps* Prolume luciferase with RCAD substitution at $C_6$ and with KCSD substitution at $C_9$);

[SEQ ID NO: 704]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANV
KCSDLLKKWLPQRCATFASKIQGQVDKIKGAGGDKDEL
(intracellular *Gaussia princeps* Prolume KDEL luciferase with RCAD substitution at $C_6$ and with KCSD substitution at $C_9$)
;

-continued

[SEQ ID NO: 706]
DLDADRGKLPGKKLPLEVLKEIEANARKAGCTRGCLICLSHIKCTPKMKKF
IPGRCHTYEGDKESAQGGIGEAIVDIPEIPGFKDLEPMEQFIAQVDRCADCTTGCLKGLANV
KCSDLLKKWLPQRCATFASKIQGQVDKIKGAGGD
(intracellular *Gaussia princeps* Mutant 1 luciferase with RCAD substitution at $C_6$ and with KCSD substitution at $C_9$);

[SEQ ID NO: 708]
DLDADRGKLPGKKLPLEVLKELEANARKAGCTRGCLICLSHIKCTPKMKK
FIPGRCHTYEGDKESAQGGIGEAIVDIPEIPGFKDLEPLEQFIAQVDRCADCTTGCLKGLANV
KCSDLLKKWLPQRCATFASKIQGQVDKIKGAGGD
(intracellular *Gaussia princeps* Mutant 2 luciferase with RCAD substitution at $C_6$ and with KCSD substitution at $C_9$);

[SEQ ID NO: 710]
DLDADRGKLPGKKLPLEVLKEMEANARKAGCTRGCLICLSHIKCTPKMKK
FIPGRCHTYEGDKESAQGGIGEAIVDIPEIPGFKDLEPMEQFIAQVDRCADCTTGCLKGLANV
KCSDLLKKWLPQRCATFASKIQGQVDKIKGAGGD
(intracellular *Gaussia princeps* GS luciferase with RCAD substitution at $C_6$ and with KCSD substitution at $C_9$)

[SEQ ID NO: 712]
DVDANRGGHGGHPGKKMPKEVLVEMEANAKRAGCHRGCLICLSHIKCTK
KMICKFIPGRCHSYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2a luciferase with RCAD substitution at $C_6$ and with KCSD substitution at $C_9$);

[SEQ ID NO: 714]
DVDANRGGHGGHPGKKMPKEVLVEMEANAKRAGCHRGCLICLSHIKCTK
KMKKFIPGRCHSYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2bv1 luciferase with RCAD substitution at $C_6$ and with KCSD substitution at $C_9$);

[SEQ ID NO: 716]
DVDANRGGHGGHPGKKMPKEVPVEMEANAKRAGCHRGCLICLSHIKCTK
KMKKFIPGRCHSYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2bv2 luciferase with RCAD substitution at $C_6$ and with KCSD substitution at $C_9$);

[SEQ ID NO: 718]
DVDANRGGHGGHPGKKMPKEVLMEMEANAKRAGCHRGCLVCLSHIKCT
AQMQKFIPGRCHSYAGDKDSAQGGIAGGAIVDIPEIAGFKEMKPMEQFIAQVDRCADCTTGC
LKGLANVKCSDLLKKWLPSRCKTFASKIQSQVDTIKGLAGDR
(intracellular *Metridia longa* 22 luciferase with RCAD substitution at $C_6$ and with KCSD substitution at $C_9$);

[SEQ ID NO: 720]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(intracellular *Metridia pacifica* 1v1 luciferase with RCAD substitution at $C_6$ and with KCSD substitution at $C_9$);

[SEQ ID NO: 722]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(intracellular *Metridia pacifica* 1v2 luciferase with RCAD substitution at $C_6$ and with KCSD substitution at $C_9$);

[SEQ ID NO: 724]
NSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDRCADCTTGCLKGLANV
KCSDLLKKWLPDRCASFADKIQSEVDNIKGLAGDR
(intracellular *Metridia pacifica* 1v3 luciferase with RCAD substitution at $C_6$ and with KCSD substitution at $C_9$);

[SEQ ID NO: 726]
NTDSNRGKMPGKKLPLAVLIEMEANAFKAGCTRGCLICLSKIKCTAKMKK
YIPGRCHDYGGDKKTGQAGIVGAIVDIPDISGFKEMGPMEQFIAQVDRCADCTTGCLKGLAN
VKCSDLLKKWLPDRCASFADKIQSEVHNIKGLAGDR
(intracellular *Metridia longa* 39 luciferase with RCAD substitution at $C_6$ and with KCSD substitution at $C_9$)
;

-continued

[SEQ ID NO: 728]
NNDVNRGKMPGKKLPLEVLIEMEANAFKAGCTRGCLICLSKIKCTAKMKQ
YIPGRCHDYGGDKKTGQAGIVGAIVDIPEISGFKEMEPMEQFIAQVDRCADCTTGCLKGLAN
VKCSDLLKKWLPDRCASFADKIQKEAHNIKGLAGDR
(intracellular *Metridia longa* 7 luciferase with RCAD substitution at $C_6$ and with KCSD substitution at $C_9$);

[SEQ ID NO: 730]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* GS luciferase with RCAD substitution at $C_6$ and with KCSD substitution at $C_9$);

[SEQ ID NO: 732]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 164M3 luciferase with RCAD substitution at $C_6$ and with KCSD substitution at $C_9$);

[SEQ ID NO: 734]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 164v1 luciferase with RCAD substitution at $C_6$ and with KCSD substitution at $C_9$);

[SEQ ID NO: 736]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVERCADCTTGCLKGLA
NVKCSDLLKKWLPDRCASFADKIQKEVHNIKGMAGDR
(intracellular *Metridia longa* 164v2 luciferase with RCAD substitution at $C_6$ and with KCSD substitution at $C_9$);

[SEQ ID NO: 738]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 164v2 luciferase with RCAD substitution at $C_6$ and with KCSD substitution at $C_9$);

[SEQ ID NO: 740]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 45 luciferase with RCAD substitution at $C_6$ and with KCSD substitution at $C_9$);

[SEQ ID NO: 742]
ETDANRGKMPGKKLPLAVIMEMEANAFKAGCTRGCLICLSKIKCTAKMK
VYIPGRCHDYGGDKKTGQAGIVGAIVDIPEISGFKEMEPMEQFIAQVDRCADCNTGCLKGLA
NVKCSDLLKKWLPDRCASFADKIQKEVHNIKGMAGDR
(intracellular *Metridia longa* 52 luciferase with RCAD substitution at $C_6$ and with KCSD substitution at $C_9$);

[SEQ ID NO: 744]
ETDANRGKMPGKKLPLAVIMEMEANAFKAGCTRGCLICLSKIKCTAKMK
VYIPGRCHDYGGDKKTGQAGIVGAIVDIPEISGFKEMAPMEQFIAQVDRCADCTTGCLKGLA
NVKCSDLLKKWLPGRCASFADKIQKEVHNIKGMAGDR
(intracellular *Metridia longa* AL luciferase with RCAD substitution at $C_6$ and with KCSD substitution at $C_9$);

[SEQ ID NO: 746]
DLDADRGKLPGKKLPLEVLKEMEANARKAGCTRGCLICLSHIKCTPKMKK
FIPGRCADYEGDKESAQGGIGEAIVDEPEIPGFKDLEPMEQFIAQVDRCADCTTGCLKGLANV
KCSDLLKKWLPQRCATFASKIQGQVDKIKGAGGD
(intracellular *Gaussia princeps* Prolume luciferase with RCAD substitution at $C_5$ and at $C_6$ and with KCSD substitution at $C_9$);

[SEQ ID NO: 748]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDRCADCTTGCLKGLANV
KCSDLLKKWLPQRCATFASKIQGQVDKIKGAGGDKDEL
(intracellular *Gaussia princeps* Prolume KDEL luciferase with RCAD substitution at $C_5$ and at $C_6$ and with KCSD substitution at $C_9$);

-continued

[SEQ ID NO: 750]
DLDADRGKLPGKKLPLEVLKEIEANARKAGCTRGCLICLSHIKCTPKMKKF
IPGRCADYEGDKESAQGGIGEAIVDIPEIPGFKDLEPMEQFIAQVDRCADCTTGCLKGLANV
KCSDLLKKWLPQRCATFASKIQGQVDKIKGAGGD
(intracellular *Gaussia princeps* Mutant 1 luciferase with RCAD substitution at $C_5$ and at $C_6$ and with KCSD substitution at $C_9$);

[SEQ ID NO: 752]
DLDADRGKLPGKKLPLEVLKELEANARKAGCTRGCLICLSHIKCTPKMKK
FIPGRCADYEGDKESAQGGIGEAIVDIPEIPGFKDLEPLEQFIAQVDRCADCTTGCLKGLANV
KCSDLLKKWLPQRCATFASKIQGQVDKIKGAGGD
(intracellular *Gaussia princeps* Mutant 2 luciferase with RCAD substitution at $C_5$ and with KCSD substitution at $C_9$);

[SEQ ID NO: 754]
DLDADRGKLPGKKLPLEVLKEMEANARKAGCTRGCLICLSHIKCTPKMKK
FIPGRCADYEGDKESAQGGIGEAIVDIPEIPGFKDLEPMEQFIAQVDRCADCTTGCLKGLANV
KCSDLLKKWLPQRCATFASKIQGQVDKIKGAGGD
(intracellular *Gaussia princeps* GS luciferase with RCAD substitution at $C_5$ and at $C_6$ and with KCSD substitution at $C_9$);

[SEQ ID NO: 756]
DVDANRGGHGGHPGKKMPKEVLVEMEANAKRAGCHRGCLICLSHLKCTK
KMKKFIPGRCADYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2a luciferase with RCAD substitution at $C_5$ and at $C_6$ and with KCSD substitution at $C_9$);

[SEQ ID NO: 758]
DVDANRGGHGGHPGKKMPKEVLVEMEANAKRAGCHRGCLICLSHIKCTK
KMKKFIPGRCADYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2bv1 luciferase with RCAD substitution at $C_5$ and at $C_6$ and with KCSD substitution at $C_9$);

[SEQ ID NO: 760]
DVDANRGGHGGHPGKKMPKEVPVEMEANAKRAGCHRGCLICLSHIKCTK
KMKKFIPGRCADYEGDKDSAQGGIGEEIVDMPEIPGFKDKEPMDQFIAQVDRCADCTTGCLK
GLANVKCSDLLKKWLPSRCKTFASKIQSQVDTIKGLAGDR
(intracellular *Metridia pacifica* 2bv2 luciferase with RCAD substitution at $C_5$ and at $C_6$ and with KCSD substitution at $C_9$);

[SEQ ID NO: 762]
DVDANRGGHGGHPGKKMPKEVLMEMEANAKRAGCHRGCLVCLSHIKCT
AQMQKFIPGRCADYAGDKDSAQGGIAGGAIVDIPEIAGFKEMKPMEQFIAQVDRCADCTTGC
LKGLANVKCSDLLKKWLPSRCKTFASKIQSQVDTIKGLAGDR
(intracellular *Metridia longa* 22 luciferase with RCAD substitution at $C_5$ and at $C_6$ and with KCSD substitution at $C_9$);

[SEQ ID NO: 764]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSDLLKKWLPDRCASFADKIQSEVDNIKGLAGDR
(intracellular *Metridia pacifica* 1v1 luciferase with RCAD substitution at $C_5$ and at $C_6$ and with KCSD substitution at $C_9$);

[SEQ ID NO: 766]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADCTTGCLKGLANV
KCSDLLKKWLPDRCASFADKIQSEVDNIKGLAGDR
(intracellular *Metridia pacifica* 1v2 luciferase with RCAD substitution at $C_5$ and at $C_6$ and with KCSD substitution at $C_9$);

[SEQ ID NO: 768]
NSDADRGKMPGKKLPLEVLIEMEANARKAGCTRGCLICLSKIKCTAKMKV
YIPGRCADYGGDKKTGQAGIVGAIVDIPEISGFKELGPMEQFIAQVDRCADMGCLKGLANV
KCSDLLKKWLPDRCASFADKIQSEVDNIKGLAGDR
(intracellular *Metridia pacifica* 1v3 luciferase with RCAD substitution at $C_5$ and at $C_6$ and with KCSD substitution at $C_9$);

[SEQ ID NO: 770]
NTDSNRGKMPGKKLPLAVLIEMEANAFKAGCTRGCLICLSKIKCTAKMKK
YIPGRCADYGGDKKTGQAGIVGAIVDIPDISGFKEMGPMEQFIAQVDRCADCTTGCLKGLAN
VKCSDLLKKWLPDRCASFADKIQSEVHNIKGLAGDR
(intracellular *Metridia longa* 39 luciferase with RCAD substitution at $C_5$ and at $C_6$ and with KCSD substitution at $C_9$);

-continued

[SEQ ID NO: 772]
NNDVNRGKMPGKKLPLEVLIEMEANAFKAGCTRGCLICLSKIKCTAKMKQ
YIPGRCADYGGDKKTGQAGIVGAIVDIPEISGFKEMEPMEQFIAQVDRCADCTTGCLKGLAN
VKCSDLLKKWLPDRCASFADKIQKEAHNIKGLAGDR
(intracellular *Metridia longa* 7 luciferase with RCAD substitution at $C_5$ and at $C_6$ and with KCSD substitution at $C_9$);

[SEQ ID NO: 774]
ETDANRGKMPGKKLPLAVIMEMEANAFKAGCTRGCLICLSKIKCTAKMK
VYIPGRCADYGGDKKTGQAGIVGANDIPEISGFKEMAPMEQFIAQVDRCADCTTGCLKGLA
NVKCSDLLKKWLPDRCASFADKIQKEVHNIKGMAGDR
(intracellular *Metridia longa* GS luciferase with RCAD substitution at $C_5$ and at $C_6$ and with KCSD substitution at $C_9$);

[SEQ ID NO: 776]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 164M3 luciferase with RCAD substitution at $C_5$ and at $C_6$ and with KCSD substitution at $C_9$);

[SEQ ID NO: 778]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 164v1 luciferase with RCAD substitution at $C_5$ and at $C_6$ and with KCSD substitution at $C_9$);

[SEQ ID NO: 780]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVERCADCTTGCLKGLA
NVKCSDLLKKWLPDRCASFADKIQKEVHNIKGMAGDR
(intracellular *Metridia longa* 164v2 luciferase with RCAD substitution at $C_5$ and at $C_6$ and with KCSD substitution at $C_9$);

[SEQ ID NO: 782]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSDLLKKWLPDRCASFADKIQKEVHNIKGMAGDR
(intracellular *Metridia longa* 16 luciferase with RCAD substitution at $C_5$ and at $C_6$ and with KCSD substitution at $C_9$);

[SEQ ID NO: 784]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCADCTTGCLKGLA
NVKCSDLLKKWLPDRCASFADKIQKEVHNIKGMAGDR
(intracellular *Metridia longa* 45 luciferase with RCAD substitution at $C_5$ and at $C_6$ and with KCSD substitution at $C_9$);

[SEQ ID NO: 786]
ETDANRGKMPGKKLPLAVIMEMEANAFKAGCTRGCLICLSKIKCTAKMK
VYIPGRCADYGGDKKTGQAGIVGAIVDIPEISGFKEMEPMEQFIAQVDRCADCNTGCLKGLA
NVKCSDLLKKWLPDRCASFADKIQKEVHNIKGMAGDR
(intracellular *Metridia longa* 52 luciferase with RCAD substitution at $C_5$ and at $C_6$ and with KCSD substitution at $C_9$);

[SEQ ID NO: 788]
ETDANRGKMPGKKLPLAVIMEMEANAFKAGCTRGCLICLSKIKCTAKMK
VYIPGRCADYGGDKKTGQAGIVGAIVDIPEISGFKEMAPMEQFIAQVDRCADCTTGCLKGLA
NVKCSDLLKKWLPGRCASFADKIQKEVHNIKGMAGDR
(intracellular *Metridia longa* AL luciferase with RCAD substitution at $C_5$ and at $C_6$ and with KCSD substitution at $C_9$);
or (b) an amino acid sequence that shares at least 70% (and at least 71% to at least 99% and all integer percentages in between) sequence similarity or sequence identity with the sequence set forth in any one of SEQ ID NO: 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above; or (c) an amino acid sequence which is encoded by the nucleotide sequence set forth in any one of:

[SEQ ID NO: 481]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Prolume luciferase
with RCAD substitution at $C_5$);

[SEQ ID NO: 483]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ayaargaygarytn
(nucleotide sequence encoding intracellular *Gaussia princeps*
Prolume KDEL luciferase with RCAD substitution at $C_5$);

[SEQ ID NO: 485]
gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 1
luciferase with RCAD substitution at $C_5$);

[SEQ ID NO: 487]
gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnytngarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 2
luciferase with RCAD substitution at $C_5$);

[SEQ ID NO: 489]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtncartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* GS luciferase with
RCAD substitution at $C_5$);

[SEQ ID NO: 491]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngayytntgygtngaytgyacnacnggntyytnaarggnytngcnaaygt
ncaytgywsngcnytnytnaaraartggytnccnwsnmgntgyaaracnttygcnwsnaarathcarwsncargtngayacnathaarggn
ytngcnggngaymgn
(nucleotide sequence encoding intracellular *Metridia pacifica* 2a
luciferase with RCAD substitution at $C_5$);

[SEQ ID NO: 493]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica*
2bv1 luciferase with RCAD substitution at $C_5$);

-continued

[SEQ ID NO: 495]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
ncaytgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica*
2bv2 luciferase with RCAD substitution at $C_5$);

[SEQ ID NO: 497]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgygcngaytaygcnggngayaargaywsngcncarggnggnathgcnggnggngcnathgtngayathccngarath
gcnggnttyaargaratgaarccnatggarcarttyathgcncargtngayytntgygargaytgyacnacnggntgyytnaarggnytngcna
aygtncaytgywsngayytnytnaaraartggytnccnwsnmgntgyaaracnttygcnwsnaarathcarwsncargtngayacnathaa
rggnytngcnggngaymgn
(nucleotide sequence encoding intracellular *Metridia longa*
22 luciferase with RCAD substitution at $C_5$);

[SEQ ID NO: 499]
aaywsngaygcngaymgnggnaaratgccnggnaaraarytnccnytngargtnytnathgaratggargcnaa
ygcnmgnaargcnuntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v1
luciferase with RCAD substitution at $C_5$);

[SEQ ID NO: 501]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v2
luciferase with RCAD substitution at $C_5$);

[SEQ ID NO: 503]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngcnytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v3
luciferase with RCAD substitution at $C_5$);

[SEQ ID NO: 505]
aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgygcngaytayggnggngayaaraaracnggncargcnggnathgtnggngcnathgtngayathccngayathwsnggnttyaargar
atgggnccnatggarcarttyathgcncargtngaymgntgyacngaytgyacnacnggntgyytnaarggnytngcnaaygtnaartgyws
ngarytnytnaaraartggytnccngaymgntgygcnwsnttygcngayaarathcarwsngargtncayaayathaarggnytngcnggn
gaymgn
(nucleotide sequence encoding intracellular *Metridia longa* 39 luciferase
with RCAD substitution at $C_5$);

[SEQ ID NO: 507]
aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gygcngaytayggnggngayaaraaracnggncargcnggnathgtnggngcnathgtngayathccngarathwsnggnttyaargarat
ggarccnatggarcarttyathgcncargtngayytntgygcngaytgyacnacnggntgyytnaarggnytngcnaaygtnaartgywsng
arytnytnaaraartggytnccngaymgntgygcnwsnttygcngayaarathcaraargargcncayaayathaarggnytngcnggngay
mgn
(nucleotide sequence encoding intracellular *Metridia longa* 7 luciferase with
RCAD substitution at $C_5$);

[SEQ ID NO: 509]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnanmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* GS luciferase
with RCAD substitution at $C_5$);

-continued

[SEQ ID NO: 511]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase
with RCAD substitution at $C_5$);

[SEQ ID NO: 513]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase
with RCAD substitution at $C_5$);

[SEQ ID NO: 515]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase
with RCAD substitution at $C_5$);

[SEQ ID NO: 517]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgyacnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase with
RCAD substitution at $C_5$);

[SEQ ID NO: 519]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcnwsntgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 45 luciferase with
RCAD substitution at $C_5$);

[SEQ ID NO: 521]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcnwsntgyaayacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 52 luciferase with
RCAD substitution at $C_5$)

[SEQ ID NO: 523]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngayytntgygcnacntgyacnacnggntgyytnaarggnytngcnaaygtnaangywsng
arytnytnaaraartggytnccnggnmgntgygcnwsnttygcngayaarathcaraargargtncayaayathaarggnatggcnggngay
mgn
(nucleotide sequence encoding intracellular *Metridia longa* AL luciferase with
RCAD substitution at $C_5$);

[SEQ ID NO: 525]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Prolume
luciferase with RCAD substitution at $C_6$);

[SEQ ID NO: 527]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaaraartggytnccncarmgntgygcnacnttygcnwsnaarathcarggncargtngayaarathaarggngcnggnggn
gayaargaygarytn
(nucleotide sequence encoding intracellular *Gaussia princeps* Prolume KDEL luciferase with RCAD substitution at $C_6$);

[SEQ ID NO: 529]
gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Mutant 1 luciferase with RCAD substitution at $C_6$);

[SEQ ID NO: 531]
gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggrnathggngargcnathgtngayathccngarathccnggnttyaargay
ytngarccnytngarcarttyathgcncargtngaymgntgygcngaytgyacnacnggntgyytnaarggnytngcnaaygtncartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Mutant 2 luciferase with RCAD substitution at $C_6$);

[SEQ ID NO: 533]
gayytngaygcngaymgnggnaarytnccnggnaaraarytnccnytngargtnytaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* GS luciferase with RCAD substitution at $C_6$);

[SEQ ID NO: 535]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngcnytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2a luciferase with RCAD substitution at $C_6$);

[SEQ ID NO: 537]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngayytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2bv1 luciferase with RCAD substitution at $C_6$);

[SEQ ID NO: 539]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngayytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2bv2 luciferase with RCAD substitution at $C_6$);

[SEQ ID NO: 541]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgycaywsntaygcnggngayaargaywsngcncarggnggnathgcnggnggngcnathgtngayathccngarath
gcnggnttyaargaratgaarccnatggarcarttyathgcncargtngaymgntgygcngaytgyacnacnggntgyytnaarggnytngcn
aaygtncaytgywsngayytnytnaaraartggytnccnwsnmgntgyaaracnttygcnwsnaarathcarwsncargtngayacnatha
arggnytngcnggngaymgn
(nucleotide sequence encoding intracellular *Metridia longa* 22 luciferase with RCAD substitution at $C_6$);

-continued

[SEQ ID NO: 543]

aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathcarwsngargtngayaayathaarggnytngcngg
ngaymgn (nucleotide sequence encoding intracellular *Metridia pacifica* 1v1 luciferase with RCAD substitution at $C_6$);

[SEQ ID NO: 545]

aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathearwsngargtngayaayathaarggnytngcngg
ngaymgn (nucleotide sequence encoding intracellular *Metridia pacifica* 1v2 luciferase with RCAD substitution at $C_6$);

[SEQ ID NO: 547]

aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathcarwsngargtngayaayathaarggnytngcngg
ngaymgn (nucleotide sequence encoding intracellular *Metridia pacifica* 1v3 luciferase with RCAD substitution at $C_6$);

[SEQ ID NO: 549]

aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgycaygaytayggnggngayaaraaracnggncargcnggnathgtnggngcnathgtngayathccngayathwsnggnttyaargar
atgggnccnatggarcarttyathgcncargtngaymgntgygcngaytgyacnacnggntgyytnaarggnytngcnaaygtnaartgyw
sngarytnytnaaraartggytnccngaymgntgygcnwsnttygcngayaarathcarwsngargtncayaayathaarggnytngcngg
ngaymgn (nucleotide sequence encoding intracellular *Metridia longa* 39 luciferase with RCAD substitution at $C_6$);

[SEQ ID NO: 551]

aayaaygaygtnaaymgnggnaaratgccnggnaaraarytnccnytngargtnytnathgaratggargcnaa
ygcnttyaargcnantgyacnmgnggntgyytnathtgyytnwsnaarathaartgyacngcnaaratgaarcartayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygnaartgywsn
garytnytnaaraartggytnccngaymgntgygcnwsnttygcngayaarathcaraargargcncayaayathaarggnytngcnggnga
ymgn (nucleotide sequence encoding intracellular *Metridia longa* 7 luciferase with RCAD substitution at $C_6$);

[SEQ ID NO: 553]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* GS luciferase with RCAD substitution at $C_6$);

[SEQ ID NO: 555]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 164M3 luciferase with RCAD substitution at $C_6$);

[SEQ ID NO: 557]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn (nucleotide sequence encoding intracellular *Metridia longa* 164v1 luciferase with RCAD substitution at $C_6$);

-continued

[SEQ ID NO: 559]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargingarmgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase
with RCAD substitution at $C_6$);

[SEQ ID NO: 561]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 16 luciferase with
RCAD substitution at $C_6$);

[SEQ ID NO: 563]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
garytnytnaaraartggymccngaymgntgygcnwsnttygcngayaarathcaraargargtncayaayathaarggnatggcnggnga
ymgn
(nucleotide sequence encoding intracellular *Metridia longa* 45 luciferase with
RCAD substitution at $C_6$);

[SEQ ID NO: 565]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyaayacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 52 luciferase with
RCAD substitution at $C_6$);

[SEQ ID NO: 567]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggrnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccnggnmgntgygcnwsnttygcngayaarathcaraargargtncayaayathaarggnatggcnggnga
ymgn
(nucleotide sequence encoding intracellular *Metridia longa* AL luciferase
with RCAD substitution at $C_6$);

[SEQ ID NO: 569]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmigntgygcnacnttygcnwsnaarathcarggncargtngayaarathaarggngcnggnggng
ay
(nucleotide sequence encoding intracellular *Gaussia princeps* Prolume luciferase
with KCSD substitution at $C_9$);

[SEQ ID NO: 571]

gayytngaygcngaymgnggnaarytnccnggnaaraarytnccnytngargtnytnaargaratggargcnaa
ygcnmgnaargcnggntgyacnmgnggntgyytnathtgyymwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggrntgyytnaarggnytngcnaaygtnaartgywsn
gayytnytnaaraartggytnccncanmgntgygcnacnttygcnwsnaarathcarggncargtngayaarathaarggngcnggnggng
ayaargaygarytn
(nucleotide sequence encoding intracellular *Gaussia princeps*
Prolume KDEL luciferase with KCSD substitution at $C_9$);

[SEQ ID NO: 573]

gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 1
luciferase with KCSD substitution at $C_9$);

-continued

[SEQ ID NO: 575]
gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnytngarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 2
luciferase with KCSD substitution at $C_9$);

[SEQ ID NO: 577]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* GS luciferase with
KCSD substitution at $C_9$);

[SEQ ID NO: 579]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica* 2a
luciferase with KCSD substitution at $C_9$);

[SEQ ID NO: 581]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica*
2bv1 luciferase with KCSD substitution at $C_9$);

[SEQ ID NO: 583]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica*
2bv2 luciferase with KCSD substitution at $C_9$);

[SEQ ID NO: 585]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgycaywsntaygcnggngayaargaywsngcncarggnggnathgcnggnggngcnathgtngayathccngarath
gcnggnttyaargaratgaarccnatggarcarttyathgcncargtngayytntgygargaytgyacnacnggntgyytnaarggnytngcna
aygtnaartgywsngayytnytnaaraartggytnccnwsnmgntgyaaracnttygcnwsnaarathcarwsncargtngayacnathaar
ggnytngcnggngaymgn
(nucleotide sequence encoding intracellular *Metridia longa*
22 luciferase with KCSD substitution at $C_9$);

[SEQ ID NO: 587]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v1
luciferase with KCSD substitution at $C_9$);

[SEQ ID NO: 589]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v2
luciferase with KCSD substitution at $C_9$);

-continued

[SEQ ID NO: 591]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v3
luciferase with KCSD substitution at $C_9$);

[SEQ ID NO: 593]
aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgycaygaytayggnggngayaaraaracnggncargcnggnathgtnggngcnathgtngayathccngayathwsnggnttyaargar
atgggnccnatggarcarttyathgcncargtngaymgntgyacngaytgyacnacnggntgyytnaarggnytngcnaaygtnaartgyws
ngayytnytnaaraartggytnccngaymgntgygcnwsnttygcngayaarathcarwsngargtncayaayathaarggnytngcnggn
gaymgn
(nucleotide sequence encoding intracellular *Metridia longa* 39 luciferase
with KCSD substitution at $C_9$);

[SEQ ID NO: 595]
aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gycaygaytayggnggngayaaraaracnggncargcnggnathgtnggngcnathgtngayathccngarathwsnggnttyaargarat
ggarccnatggarcarttyathgcncargtngayytntgygcngaytgyacnacnggntgyytnaarggnytngcnaaygtnaartgywsng
ayytnytnaaraartggytnccngaymgntgygcnwsnttygcngayaarathcaraargargcncayaayathaarggnytngcnggnga
ymgn
(nucleotide sequence encoding intracellular *Metridia longa* 7 luciferase with
KCSD substitution at $C_9$);

[SEQ ID NO: 597]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccngnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* GS luciferase
with KCSD substitution at $C_9$);

[SEQ ID NO: 599]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase
with KCSD substitution at $C_9$);

[SEQ ID NO: 601]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase
with KCSD substitution at $C_9$);

[SEQ ID NO: 603]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase
with KCSD substitution at $C_9$);

[SEQ ID NO: 605]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgyacnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 16 luciferase with
KCSD substitution at $C_9$);

-continued

[SEQ ID NO: 607]
garacngaygcnaaymgnggnaaratgccnggnaararaarytnccnytngcngtnathatggaratggargcnaa
ygcnttyaargcnggntgyacnmgnggntgyytnathtgyytnwsnaarathaartgyacngcnaaratgaargtnayathccnggnmgnt
gycaygaytayggnggngayaarararacnggncargcnggnathgtnggngcnathgtngayathccngarathwsnggnttyaargarat
ggarccnatggarcarttyathgcncargtngaymgntgygcnwsntgyacnacnggntgyytnaarggnytngcnaaygtnaartgywsn
gayytnytnaararaartggytnccngaymgntgygcnwsnttygcngayaarathcaraargargtncayaayathaarggnatggcnggnga
ymgn
(nucleotide sequence encoding intracellular *Metridia longa* 45 luciferase with
KCSD substitution at $C_9$);

[SEQ ID NO: 609]
garacngaygcnaaymgnggnaaratgccnggnaararaarytnccnytngcngtnathatggaratggargcnaa
ygcnttyaargcnggntgyacnmgnggntgyytnathtgyytnwsnaarathaartgyacngcnaaratgaargtnayathccnggnmgnt
gycaygaytayggnggngayaarararacnggncargcnggnathgtnggngcnathgtngayathccngarathwsnggnttyaargarat
ggarccnatggarcarttyathgcncargtngaymgntgygcnwsntgyaayacnggntgyytnaarggnytngcnaaygtnaartgywsn
gayytnytnaararaartggytnccngaymgntgygcnwsnttygcngayaarathcaraargargtncayaayathaarggnatggcnggnga
ymgn
(nucleotide sequence encoding intracellular *Metridia longa* 52 luciferase with
KCSD substitution at $C_9$);

[SEQ ID NO: 611]
garacngaygcnaaymgnggnaaratgccnggnaararaarytnccnytngcngtnathatggaratggargcnaa
ygcnttyaargcnggntgyacnmgnggntgyytnathtgyytnwsnaarathaartgyacngcnaaratgaargtnayathccnggnmgnt
gycaygaytayggnggngayaarararacnggncargcnggnathgtnggngcnathgtngayathccngarathwsnggnttyaargarat
ggcnccnatggarcarttyathgcncargtngayytntgygcnacntgyacnacnggntgyytnaarggnytngcnaaygtnaartgywsng
ayytnytnaararaartggytnccnggnmgntgygcnwsnttygcngayaarathcaraargargtncayaayathaarggnatggcnggngay
mgn
(nucleotide sequence encoding intracellular *Metridia longa* AL luciferase with
KCSD substitution at $C_9$);

[SEQ ID NO: 613]
gayytngaygcngaymgnggnaarytnccnggnaararaarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaararaartggytnccncarmgntgygcnacnttygcnwsnaarathcarggncargtngayaarathaarggngcnggnggn
gay
(nucleotide sequence encoding intracellular *Gaussia princeps* Prolume
luciferase with RCAD substitution at $C_5$ and at $C_6$);

[SEQ ID NO: 615]
gayytngaygcngaymgnggnaarytnccnggnaararaarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaararaartggytnccncarmgntgygcnacnttygcnwsnaarathcarggncargtngayaarathaarggngcnggnggn
gayaargaygarytn
(nucleotide sequence encoding intracellular *Gaussia princeps*
Prolume KDEL luciferase with RCAD substitution at $C_5$ and at $C_6$);

[SEQ ID NO: 617]
gayytngaygcngaymgnggnaarytnccnggnaararaarytnccnytngargtnytnaargarathgargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaararaartggytnccncarmgntgygcnacnttygcnwsnaarathcarggncargtngayaarathaarggngcnggnggn
gay
(nucleotide sequence encoding intracellular *Gaussia princeps* Mutant 1
luciferase with RCAD substitution at $C_5$ and at $C_6$);

[SEQ ID NO: 619]
gayytngaygcngaymgnggnaarytnccnggnaararaarytnccnytngargtnytnaargarytngargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnytngarcarttyathgcncargtngaymgntgygcngaytgyacnacnggntgyytnaarggnytngcnaaygtncartgyws
ngayytnytnaararaartggytnccncarmgntgygcnacnttygcnwsnaarathcarggncargtngayaarathaarggngcnggnggn
gay
(nucleotide sequence encoding intracellular *Gaussia princeps* Mutant 2
luciferase with RCAD substitution at $C_5$);

[SEQ ID NO: 621]
gayytngaygcngaymgnggnaarytnccnggnaararaarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtncartgyws
ngayytnytnaararaartggytnccncarmgntgygcnacnttygcnwsnaarathcarggncargtngayaarathaarggngcnggnggn
gay
(nucleotide sequence encoding intracellular *Gaussia princeps* GS luciferase
with RCAD substitution at $C_5$ and at $C_6$);

-continued

[SEQ ID NO: 623]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngcnytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2a luciferase with RCAD substitution at $C_5$ and at $C_6$);

[SEQ ID NO: 625]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngayytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2bv1 luciferase with RCAD substitution at $C_5$ and at $C_6$);

[SEQ ID NO: 627]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtncaytgywsngayytnytnaaraartggytnccnwsnmgntgyaaracnttygcnwsnaarathcarwsncargtngayacnathaarg
gnytngcnggngaymgn
(nucleotide sequence encoding intracellular *Metridia pacifica* 2bv2 luciferase with RCAD substitution at $C_5$ and at $C_6$);

[SEQ ID NO: 629]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgygcngaytaygcnggngayaargaywsngcncarggnggnathgcnggnggngcnathgtngayathccngarath
gcnggnttyaargaratgaarccnatggarcarttyathgcncargtngaymgntgygcngaytgyacnacnggntgyytnaarggnytngcn
aaygtncaytgywsngayytnytnaaraartggytnccnwsnmgntgyaaracnttygcnwsnaarathcarwsncargtngayacnatha
arggnytngcnggngaymgn
(nucleotide sequence encoding intracellular *Metridia longa* 22 luciferase with RCAD substitution at $C_5$ and at $C_6$);

[SEQ ID NO: 631]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v1 luciferase with RCAD substitution at $C_5$ and at $C_6$);

[SEQ ID NO: 633]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v2 luciferase with RCAD substitution at $C_5$ and at $C_6$);

[SEQ ID NO: 635]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngcnytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v3 luciferase with RCAD substitution at $C_5$ and at $C_6$);

[SEQ ID NO: 637]
aayacngaywsnaaymgnggnaaratgccnggnaaraarytnccnytngcngtnytnathgaratggargcna
aygcnttyaargcnggntgyacnmgnantgyytnathtgyytnwsnaarathaartgyacngcnaaratgaaraartayathccnggnmg
ntgygcngaytayggnggngayaaraaracnggncargcnggnathgtnggngcnathgtngayathccngayathwsnggnttyaargar
atgggnccnatggarcarttyathgcncargtngaymgntgygcngaytgyacnacnggntgyytnaarggnytngcnaaygtnaartgyw
sngarytnytnaaraartggytnccngaymgntgygcnwsnttygcngayaarathcarwsngargtncayaayathaarggnytngcngg
ngaymgn
(nucleotide sequence encoding intracellular *Metridia longa* 39 luciferase with RCAD substitution at $C_5$ and at $C_6$);

-continued

[SEQ ID NO: 639]

aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargcncayaayathaarggnytngcnggnga
ymgn
(nucleotide sequence encoding intracellular *Metridia longa* 7 luciferase with
RCAD substitution at $C_5$ and at $C_6$);

[SEQ ID NO: 641]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgmtgygcnwsnttygcngayaarathcaraargargtncayaayathaarggnatggcnggnga
ymgn
(nucleotide sequence encoding intracellular *Metridia longa* GS luciferase
with RCAD substitution at $C_5$ and at $C_6$);

[SEQ ID NO: 643]

garacngaycnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase
with RCAD substitution at $C_5$ and at $C_6$);

[SEQ ID NO: 645]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase
with RCAD substitution at $C_5$ and at $C_6$);

[SEQ ID NO: 647]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngarmgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase
with RCAD substitution at $C_5$ and at $C_6$);

[SEQ ID NO: 649]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 16 luciferase with
RCAD substitution at $C_5$ and at $C_6$);

[SEQ ID NO: 651]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 45 luciferase with
RCAD substitution at $C_5$ and at $C_6$);

[SEQ ID NO: 653]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnunttyaargarat
ggarccnatggarcarttyathgcncargtngaymgntgygcngaytgyaayacnggntgyytnaarggnytngcnaaygtnaartgywsn
garytnytnaaraartggytnccngaymgntgygcnwsnttygcngayaarathcaraargargtncayaayathaarggnatggcnggnga
ymgn
(nucleotide sequence encoding intracellular *Metridia longa* 52 luciferase with
RCAD substitution at $C_5$ and at $C_6$);

-continued

[SEQ ID NO: 655]
garacngaygcnaaymgnggnaaratgccnggnaaraarytnccnytngcngtnathatggaratggargcnaa
ygcnttyaargcnggntgyacnmgnggntgyytnathtgyytnwsnaaratha artgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
garytnytnaaraartggytnccnggnmptgygcnwsnttygcngayaarathcaraargargtncayaayathaarggnatggcnggnga
ymgn
(nucleotide sequence encoding intracellular *Metridia longa* AL luciferase
with RCAD substitution at $C_5$ and at $C_6$);

[SEQ ID NO: 657]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Prolume luciferase
with RCAD substitution at $C_5$ and with KCSD substitution at $C_9$);

[SEQ ID NO: 659]
gayytngaygcngaymgnggnaarytnccnggnaaraarytnccnytngargtnytnaargaratggargcnaa
ygcnmgnaargcnggntgyacnmgnuntgyytnathtgyytnwsncayathaartgyacnccnaaratgaaraarttyathccnggnmg
ntgygcngaytaygarggngayaargarwsngcncarggnggnathggngargcnathgtngayathcccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ayaargaygarytn
(nucleotide sequence encoding intracellular *Gaussia princeps*
Prolume KDEL luciferase with RCAD substitution at $C_5$ and with KCSD substitution at $C_9$);

[SEQ ID NO: 661]
gayytngaygcngaymgnggnaarytnccnggnaaraarytnccnytngargtnytnaargarathgargcnaa
ygcnmgnaargcnggntgyacnmgnuntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmgntgygcnacnttygcnwsnaamthcarggncargtngayaarathaarggngcnggnggng
ay
(nucleotide sequence encoding intracellular *Gaussia princeps* Mutant 1
luciferase with RCAD substitution at $C_5$ and with KCSD substitution at $C_9$);

[SEQ ID NO: 663]
gayytngaygcngaymgnggnaarytncCnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnytngarcarttyathgcncargtngayytntgygtngaytgyacnacnggntgyytnaarggnytngcnaaygtnaartgywsn
gayytnytnaaraartggytnccncarmgntgygcnacnttygcnwsnaarathcarggncargtngayaarathaarggngcnggnggng
ay
(nucleotide sequence encoding intracellular *Gaussia princeps* Mutant 2
luciferase with RCAD substitution at $C_5$ and with KCSD substitution at $C_9$);

[SEQ ID NO: 665]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngayytntgygtngaytgyacnacnggntgyytnaarggnytngcnaaygtnaartgywsn
gayytnytnaaraartggytnccncarmptgygcnacnttygcnwsnaarathcarggncargtngayaarathaarggngcnggnggng
ay
(nucleotide sequence encoding intracellular *Gaussia princeps* GS luciferase with
RCAD substitution at $C_5$ and with KCSD substitution at $C_9$);

[SEQ ID NO: 667]
gaygtngaygcnaaymgnggnggncayggnggncayccnggnaaraaratgccnaargargtnytngtngar
atggargcnaaygcnaarmgngcnggnbmtgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica* 2a
luciferase with RCAD substitution at $C_5$ and with KCSD substitution at $C_9$);

[SEQ ID NO: 669]
gaygtngaygcnaaymgnggnggncayggnuncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica*
2bv1 luciferase with RCAD substitution at $C_5$ and with KCSD substitution at $C_9$);

-continued

[SEQ ID NO: 671]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
hccnggpmgntgygcngaytaygarggngayaargaywsngcncarggnggnathggmgargarathgtngayatgccngarathccng
gnttyaargayaargarccnatggaycarttyathgcncargtngayytntgygtngaytgyacnacnggntgyytnaarggnytngcnaaygt
naartgywsngayytnytnaaraartggytnccnwsnmgntgyaaracnttygcnwsnaarathcarwsncargtngayacnathaarggn
ytngcnggngaymgn
(nucleotide sequence encoding intracellular *Metridia pacifica* 2bv2 luciferase with RCAD substitution at $C_5$ and with KCSD substitution at $C_9$);

[SEQ ID NO: 673]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgygcngaytaygcnggngayaargaywsngcncarggnggnathgcnggnggngcnathgtngayathccngarath
gcnggnttyaargaratgaarccnatggarcarttyathgcncargtngayytntgygargaytgyacnacnggntgyytnaarggnytngcna
aygtnaartgywsngayytnytnaaraartggytnccnwsnmgntgyaaracnttygcnwsnaarathcarwsncargtngayacnathaar
ggnytngcnggngaymgn
(nucleotide sequence encoding intracellular *Metridia longa* 22 luciferase with RCAD substitution at $C_9$ and with KCSD substitution at $C_9$);

[SEQ ID NO: 675]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v1 luciferase with RCAD substitution at $C_5$ and with KCSD substitution at $C_9$);

[SEQ ID NO: 677]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v2 luciferase with RCAD substitution at $C_5$ and with KCSD substitution at $C_9$);

[SEQ ID NO: 679]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngayytntgygcngaytgyacnacnggntgyytnaarggnytngcnaaygtnaartgyws
ngayytnytnaaraartggytnccngaymgntgygcnwsnttygcngayaarathcarwsngargtngayaayathaarggnytngcnggn
gaymgn
(nucleotide sequence encoding intracellular *Metridia pacifica* 1v3 luciferase with RCAD substitution at $C_9$ and with KCSD substitution at $C_9$);

[SEQ ID NO: 681]
aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgygcngaytayggnggngayaaraaracnggncargcnggnathgtnggngcnathgtngayathccngayathwsnggnttyaargar
atgggnccnatggarcarttyathgcncargtngaymgntgyacngaytgyacnacnggntgyytnaarggnytngcnaaygtnaartgyws
ngayytnytnaaraartggytnccngaymgntgygcnwsnttygcngayaarathcarwsngargtncayaayathaarggnytngcnggn
gaymgn
(nucleotide sequence encoding intracellular *Metridia longa* 39 luciferase with RCAD substitution at $C_5$ and with KCSD substitution at $C_9$);

[SEQ ID NO: 683]
aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gygcngaytayggnggngayaaraaracnggncargcnggnathgtnggngcnathgtngayathccngarathwsnggnttyaargarat
ggarccnatggarcarttyathgcncargtngayytntgygcngaytgyacnacnggntgyytnaarggnytngcnaaygtnaartgywsng
ayytnytnaaraartggytnccngaymgntgygcnwsnttygcngayaarathcaraargargcncayaayathaarggnytngcnggnga
ymgn
(nucleotide sequence encoding intracellular *Metridia longa* 7 luciferase with RCAD substitution at $C_5$ and with KCSD substitution at $C_9$);

[SEQ ID NO: 685]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* GS luciferase with RCAD substitution at $C_5$ and with KCSD substitution at $C_9$);

-continued

[SEQ ID NO: 687]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase with RCAD substitution at $C_5$ and with KCSD substitution at $C_9$);

[SEQ ID NO: 689]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase with RCAD substitution at $C_5$ and with KCSD substitution at $C_9$);

[SEQ ID NO: 691]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngarmgntgygcnwsntgyacnacnggntgyytnaarggnytngcnaaygtnaangywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase with RCAD substitution at $C_5$ and with KCSD substitution at $C_9$);

[SEQ ID NO: 693]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgyacnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 16 luciferase with RCAD substitution at $C_5$ and with KCSD substitution at $C_9$);

[SEQ ID NO: 695]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcnwsntgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 45 luciferase with RCAD substitution at $C_5$ and with KCSD substitution at $C_9$);

[SEQ ID NO: 697]
garacngaygcnaaymgnggnaaratgccnggnaaraarytnccnytngcngtnathatggaratggargcnaa
ygcnttyaargcnggntgyacnmgnggntgyytnathtgyytnwsnaarathaaxtgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcnwsntgyaayacnggrntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 52 luciferase with RCAD substitution at $C_5$ and with KCSD substitution at $C_9$),;

[SEQ ID NO: 699]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngayytntgygcnacntgyacnacnggntgyytnaarggnytngcnaaygtnaartgywsng
ayytnytnaaraartggytnccnggnmgntgygcnwsnttygcngayaarathcaraargargtncayaayathaarggnatggcnggngay
mgn
(nucleotide sequence encoding intracellular *Metridia longa* AL luciferase with RCAD substitution at $C_9$ and with KCSD substitution at $C_9$);

[SEQ ID NO: 701]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Prolume luciferase with RCAD substitution at $C_6$ and with KCSD substitution at $C_9$);

-continued

[SEQ ID NO: 703]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gayaargaygarytn
(nucleotide sequence encoding intracellular *Gaussia princeps*
Prolume KDEL luciferase with RCAD substitution at $C_6$ and with KCSD substitution at $C_9$);

[SEQ ID NO: 705]
gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraattyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Mutant 1
luciferase with RCAD substitution at $C_6$ and with KCSD substitution at $C_9$);

[SEQ ID NO: 707]
gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnytngarcarttyathgcncargtngaymgntgygcngaytgyacnacnggntgyytnaarggnytngcnaaygtnaartgyws
ngayytnytnaaraartggytnccncanngntgygcnacnttygcnwsnaarathcarggncargtngayaarathaarggngcnggnggn
gay
(nucleotide sequence encoding intracellular *Gaussia princeps* Mutant 2
luciferase with RCAD substitution at $C_6$ and with KCSD substitution at $C_9$);

[SEQ ID NO: 709]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgycayacntaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* GS luciferase
with RCAD substitution at $C_6$ and with KCSD substitution at $C_9$);

[SEQ ID NO: 711]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggrrtgyytnaarggnytngcnaay
gtnaartgywsngayytnytnaaraartggytnccnwsnmgntgyaaracnttygcnwsnaarathcarwsncargtngayacnathaargg
nytngcnggngaymgn
(nucleotide sequence encoding intracellular *Metridia pacifica*
2a luciferase with RCAD substitution at $C_6$ and with KCSD substitution at $C_9$);

[SEQ ID NO: 713]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtnaartgywsngayytnytnaaraartggytnccnwsnmgntgyaaracnttygcnwsnaarathcarwsncargtngayacnathaargg
nytngcnggngaymgn
(nucleotide sequence encoding intracellular *Metridia pacifica*
2bv1 luciferase with RCAD substitution at $C_6$ and with KCSD substitution at $C_9$);

[SEQ ID NO: 715]
gaygtngaygcnaaymgnggnggncayggnggncayccnggnaaraaratgccnaargargtnccngtngar
atggargcnaaygcnaarmgngcnggntgycaymgnggnttgyytnathtgyytnwsncayathaartgyacnaaraaratgaaraarttyat
hccnggnmgntgycaywsntaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtnaartgywsngayytnytnaaraartggytnccnwsnmgntgyaaracnttygcnwsnaarathcarwsncargtngayacnathaargg
nytngcnggngaymgn
(nucleotide sequence encoding intracellular *Metridia pacifica*
2bv2 luciferase with RCAD substitution at $C_6$ and with KCSD substitution at $C_9$);

[SEQ ID NO: 717]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgycaywsntaygcnggngayaargaywsngcncarggnggnathgcnggnggngcnathgtngayathccngarath
gcnggnttyaargaratgaarccnatggarcarttyathgcncargtngaymgntgygcngaytgyacnacnggntgyytnaarggnytngcn
aaygtnaartgywsngayytnytnaaraartggytnccnwsnmgntgyaaracnttygcnwsnaarathcarwsncargtngayacnatha
arggnytngcnggngaymgn
(nucleotide sequence encoding intracellular *Metridia*
*longa* 22 luciferase with RCAD substitution at $C_6$ and with KCSD substitution at $C_9$);

-continued

[SEQ ID NO: 719]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngayytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v1
luciferase with RCAD substitution at $C_6$ and with KCSD substitution at $C_9$);

[SEQ ID NO: 721]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngayytnytnaaraatggytnccngaymgntgygcnwsnttygcngayaarathcarwsngargtngayaayathaarggnytngcngg
ngaymgn
(nucleotide sequence encoding intracellular *Metridia pacifica* 1v2
luciferase with RCAD substitution at $C_6$ and with KCSD substitution at $C_9$);

[SEQ ID NO: 723]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgycaygaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyynaarggnytngcnaaygtnaartgyw
sngayytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v3
luciferase with RCAD substitution at $C_6$ and with KCSD substitution at $C_9$);

[SEQ ID NO: 725]
aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgycaygaytayggnggngayaaraaracnggncargcnggnathgtnggngcnathgtngayathccngayathwsnggnttyaargar
atgggnccnatggarcarttyathgcncargtngaymgntgygcngaytgyacnacnggntgyytnaarggnytngcnaaygtnaartgyw
sngayytnytnaaraartggytnccngaymgntgygcnwsnttygcngayaarathcarwsngargtncayaayathaarggnytngcngg
ngaymgn
(nucleotide sequence encoding intracellular *Metridia longa* 39 luciferase
with RCAD substitution at $C_6$ and with KCSD substitution at $C_9$);

[SEQ ID NO: 727]
aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargcncayaayathaarggnytngcnggng
aymgn
(nucleotide sequence encoding intracellular *Metridia longa* 7 luciferase with
RCAD substitution at $C_6$ and with KCSD substitution at $C_9$);

[SEQ ID NO: 729]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* GS luciferase
with RCAD substitution at $C_6$ and with KCSD substitution at $C_9$);

[SEQ ID NO: 731]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgmt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase
with RCAD substitution at $C_6$ and with KCSD substitution at $C_9$);

[SEQ ID NO: 733]
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggrnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase
with RCAD substitution at $C_6$ and with KCSD substitution at $C_9$);

-continued

[SEQ ID NO: 735]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggrngcnathgtngayathccngarathwsnggnttyaargarat
ggcnccnatggarcarttyathgcncargtngarmgntgygcngaytgyacnacnggntgyytnaarggnytngcnaaygtnaartgywsn
gayytnytnaaraartggytnccngaymgntgygcnwsnttygcngayaarathcaraargargtncayaayathaarggrnatggcnggnga
ymgn
(nucleotide sequence encoding intracellular *Metridia longa* 164v2 luciferase
with RCAD substitution at $C_6$ and with KCSD substitution at $C_9$);

[SEQ ID NO: 737]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgmt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraanggytnccngaymgntgygcnwsnttygcngayaarathcaraargargtncayaayathaarggnatggcnggnga
ymgn
(nucleotide sequence encoding intracellular *Metridia longa* 16 luciferase with
RCAD substitution at $C_6$ and with KCSD substitution at $C_9$);

[SEQ ID NO: 739]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 45 luciferase with
RCAD substitution at $C_6$ and with KCSD substitution at $C_9$);

[SEQ ID NO: 741]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggarccnatggarcarttyathgcncargtngaymgntgygcngaytgyaayacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 52 luciferase with
RCAD substitution at $C_6$ and with KCSD substitution at $C_9$);

[SEQ ID NO: 743]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gycaygaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccnggnmgntgygcnwsnttygcngayaarathcaraargargtncayaayathaarggnatggcnggnga
ymgn
(nucleotide sequence encoding intracellular *Metridia longa* AL luciferase
with RCAD substitution at $C_6$ and with KCSD substitution at $C_9$);

[SEQ ID NO: 745]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Prolume
luciferase with RCAD substitution at $C_5$ and at $C_6$ and with KCSD substitution at $C_9$);

[SEQ ID NO: 747]

gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gayaargaygarytn
(nucleotide sequence encoding intracellular *Gaussia princeps*
Prolume KDEL luciferase with RCAD substitution at $C_5$ and at $C_6$ and with KCSD
substitution at $C_9$);

[SEQ ID NO: 749]

gayytngaygcngaymgnggnaarytnccnggnaaraarytnccnytngargtnytnaargarathgargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Mutant 1
luciferase with RCAD substitution at $C_5$ and at $C_6$ and with KCSD substitution at $C_9$);

-continued

[SEQ ID NO: 751]
gayytngaygcngaymgnggnaarytnccnggnaaraarytnccnytngargtnytnaargarytngargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnytngarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* Mutant 2 luciferase with RCAD substitution at $C_5$ and with KCSD substitution at $C_9$);

[SEQ ID NO: 753]
gayytngaygcngaymgnggnaarytnccnggnaaraarytnccnytngargtnytnaargaratggargcnaa
ygcnmgnaargcnggntgyacnmgnggntgyytnathtgyytnwsncayathaartgyacnccnaaratgaaraarttyathccnggnmg
ntgygcngaytaygarggngayaargarwsngcncarggnggnathggngargcnathgtngayathccngarathccnggnttyaargay
ytngarccnatggarcarttyathgcncargtngaymgntgygcngaytgyacnacnggntgyytnaarggnytngcnaaygtnaartgyws
ngayytnytnaaraartggytnccncarmgntgygcnacnttygcnwsnaarathcarggncargtngayaarathaarggngcnggnggn
gay
(nucleotide sequence encoding intracellular *Gaussia princeps* GS luciferase with RCAD substitution at $C_6$ and at $C_6$ and with KCSD substitution at $C_6$ );

[SEQ ID NO: 755]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtnaartgywsngayytnytnaaraartggymccnwsnmgntgyaaracnttygcnwsnaarathcarwsncargtngayacnathaargg
nytngcnggngaymgn
(nucleotide sequence encoding intracellular *Metridia pacifica* 2a luciferase with RCAD substitution at $C_5$ and at $C_6$ and with KCSD substitution at $C_9$);

[SEQ ID NO: 757]
gaygtngaygcnaaymgnggnggncayggnggncayccnggnaaraaratgccnaargargtnytngtngar
atggargcnaaygcnaarmgngcnggntgycaymgnggntgyytnathtgyytnwsncayathaartgyacnaaraaratgaaraarttyat
hccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtnaartgywsngayytnytnaaraartggytnccnwsnmgntgyaaracnttygcnwsnaarathcarwsncargtngayacnathaargg
nytngcnggngaymgn
(nucleotide sequence encoding intracellular *Metridia pacifica* 2bv1 luciferase with RCAD substitution at $C_5$ and at $C_6$ and with KCSD substitution at $C_6$ );

[SEQ ID NO: 759]
gaygtngaygcnaaymgnggnggncayggnggncayccnggnaaraaratgccnaargargtnccngtngar
atggargcnaaygcnaarmgngcnggntgycaymgnggntgyytnathtgyytnwsncayathaartgyacnaaraaratgaaraarttyat
nccnggnmgntgygcngaytaygarggngayaargaywsngcncarggnggnathggngargarathgtngayatgccngarathccng
gnttyaargayaargarccnatggaycarttyathgcncargtngaymgntgygcngaytgyacnacnggntgyytnaarggnytngcnaay
gtnaartgywsngayytnytnaaraartggytnccnwsnmgntgyaaracnttygcnwsnaarathcarwsncargtngayacnathaargg
nytngcnggngaymgn
(nucleotide sequence encoding intracellular *Metridia pacifica* 2bv2 luciferase with RCAD substitution at $C_5$ and at $C_6$ and with KCSD substitution at $C_9$);

[SEQ ID NO: 761]
gaygtngaygcnaaymgnggnggncayggnggncayccnggnaaraaratgccnaargargtnytnatggara
tggargcnaaygcnaarmgngcnggntgycaymgnggntgyytngtntgyytnwsncayathaartgyacngcncaratgcaraarttyat
hccnggnmgntgygcngaytaygcnggngayaargaywsngcncarggnggnathgcnggnggngcnathgtngayathccngarath
gcnggnttyaargaratgaarccnatggarcarttyathgcncargtngaymgntgygcngaytgyacnacnggntgyynaarggnytngcn
aaygtnaartgywsngayytnytnaaraartggytnccnwsnmgntgyaaracnttygcnwsnaarathcarwsncargtngayacnatha
arggnytngcnggngaymgn
(nucleotide sequence encoding intracellular *Metridia longa* 22 luciferase with RCAD substitution at $C_5$ and at $C_6$ and with KCSD substitution at $C_9$);

[SEQ ID NO: 763]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgngayathccngarathwsnggnttyaargar
ytnggnccnatggarcarttyathgcncargtngaymgntgygcngaytgyacnacnggntgyytnaarggnytngcnaaygtnaartgyw
sngayytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v1 luciferase with RCAD substitution at $C_5$ and at $C_6$ and with KCSD substitution at $C_9$);

[SEQ ID NO: 765]
aaywsngaygcngaymgnggnaaratgccnggnaaraarytnccnytngargtnytnathgaratggargcnaa
ygcnmgnaargcnggntgyacnmgnggntgyytnathtgyytnwsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngaymgntgygcngaytgyacnacnggntgyytnaarggnytngcnaaygtnaartgyw
sngayytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v2 luciferase with RCAD substitution at $C_5$ and at $C_6$ and with KCSD substitution at $C_9$);

-continued

[SEQ ID NO: 767]

aaywsngaygcngaymgnggnaaratgccnggnaaraarytnccnytngargtnytnathgaratggargcnaa
ygcnmgnaargcnggntgyacnmgnggntgyytnathtgyytn wsnaarathaartgyacngcnaaratgaargtntayathccnggnmg
ntgygcngaytayggnggngayaaraaracnggncargcnggnathgtnggngcnathgtngayathccngarathwsnggnttyaargar
ytnggnccnatggarcarttyathgcncargtngaymgmtgygcngaytgyacnacnggntgyytnaarggnytngcnaaygtnaartgyw
sngayytnytnaaraartggytnccngaymgntgygcnwsnttygcngayaarathcarwsngargtngayaayathaarggnytngcngg
ngaymgn
(nucleotide sequence encoding intracellular *Metridia pacifica* 1v3
luciferase with RCAD substitution at $C_5$ and at $C_6$ and with KCSD substitution at $C_9$);

[SEQ ID NO: 769]

aayacngaywsnaaymgnggnaaratgccnggnaaraarytnccnytngcngtnytnathgaratggargcna
aygcnttyaargcnggntgyacnmgnggntgyytnathtgyytnwsnaarathaartgyacngcnaaratgaaraartayathccnggnmg
ntgygcngaytayggnggngayaaraaracnggncargcnggnathgtnggngcnathgtngayathccngayathwsnggnttyaargar
atgggnccnatggarcarttyathgcncargtngaymgntgygcngaytgyacnacnggntgyytnaarggnytngcnaaygtnaartgyw
sngayytnytnaaraartggytnccngaymgntgygcnwsnttygcngayaarathcarwsngargtncayaayathaarggnytngcngg
ngaymgn
(nucleotide sequence encoding intracellular *Metridia longa* 39 luciferase
with RCAD substitution at $C_5$ and at $C_6$ and with KCSD substitution at $C_9$);

[SEQ ID NO: 771]

aayaaygaygtnaaymgnggnaaratgccnggnaaraarytnccnytngargtnytnathgaratggargcnaa
ygcnttyaargcnggntgyacnmgnggntgyytnathtgyytnwsnaarathaartgyacngcnaaratgaarcartayathccnggnmgnt
gygcngaytayggnggngayaaraaracnggncargcnggnathgtnggngcnathgtn gayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargcncayaayathaarggnytngcnggng
aymgn
(nucleotide sequence encoding intracellular *Metridia longa* 7 luciferase with
RCAD substitution at $C_5$ and at $C_6$ and with KCSD substitution at $C_9$);

[SEQ ID NO: 773]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* GS luciferase
with RCAD substitution at $C_5$and at $C_6$ and with KCSD substitution at $C_9$);

[SEQ ID NO: 775]

garacngaygcnaaymgnggnaaratgccnggnaaraarytnccnytngcngtnathatggaratggargcnaa
ygcnttyaargcnggntgyacnmgnggntgyytnathtgyymwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164M3 luciferase
with RCAD substitution at $C_5$ and at $C_6$ and with KCSD substitution at $C_9$);

[SEQ ID NO: 777]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v1 luciferase
with RCAD substitution at $C_5$ and at $C_6$ and with KCSD substitution at $C_9$);

[SEQ ID NO: 779]

garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngarmgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 164v2 luciferase
with RCAD substitution at $C_5$ and at $C_6$ and with KCSD substitution at $C_9$);

[SEQ ID NO: 781]

garacngaygcnaaymgnggnaaratgccnggnaaraarytnccnytngcngtnathatggaratggargcnaa
ygcnttyaargcnggntgyacnmgnggntgyytnathtgyynwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
(nucleotide sequence encoding intracellular *Metridia longa* 16 luciferase with
RCAD substitution at $C_5$ and at $C_6$ and with KCSD substitution at $C_9$);

-continued

[SEQ ID NO: 783]

```
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcngaytgyacnacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
```

(nucleotide sequence encoding intracellular *Metridia longa* 45 luciferase with RCAD substitution at $C_5$ and at $C_6$ and with KCSD substitution at $C_9$);

[SEQ ID NO: 785]

```
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggarccnatggarcarttyathgcncargtngaymgntgygcngaytgyaayacnggntgyytnaarggnytngcnaaygtnaartgywsn
gayytnytnaaraartggytnccngaymgntgygcnwsnttygcngayaarathcaraargargtncayaayathaarggnatggcnggnga
ymgn
```

(nucleotide sequence encoding intracellular *Metridia longa* 52 luciferase with RCAD substitution at $C_5$ and at $C_6$ and with KCSD substitution at $C_9$);
or

[SEQ ID NO: 787]

```
garacngaygcnaaymgnggnaaratgccnggnaaraarytnccnytngcngtnathatggaratggargcnaa
ygcnttyaargcnggntgyacnmgnggntgyytnathtgyytnwsnaarathaartgyacngcnaaratgaargtntayathccnggnmgnt
gygcngaytayggnggngayaaraaracnggncargcnggnathgtnggngcnathgtngayathccngarathwsnggnttyaargarat
ggcnccnatggarcarttyathgcncargtngaymgntgygcngaytgyacnacnggntgyytnaarggnytngcnaaygtnaartgywsn
gayytnytnaaraartggytnccnggnmgntgygcnwsnttygcngayaarathcaraargargtncayaayathaarggnatggcnggnga
ymgn
```

(nucleotide sequence encoding intracellular *Metridia longa* AL luciferase with RCAD substitution at $C_5$ and at $C_6$ and with KCSD substitution at $C_9$),
or a complement thereof;

(d) an amino acid sequence which is encoded by a nucleotide sequence that shares at least 70% (and at least 71% to at least 99% and all integer percentages in between) sequence identity with the sequence set forth in any one of SEQ ID NO: 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or a complement thereof, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above; or (e) an amino acid sequence which is encoded by a nucleotide sequence that hybridizes under at least medium or high stringency conditions to the sequence set forth in any one of SEQ ID NO: 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or a complement thereof, wherein the amino acid sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above.

In some embodiments, $X_1$ in formula X is L or modified form thereof.

In some embodiments, $X_{43}$ is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof.

In some embodiments, the polypeptides comprising an amino acid sequence according to formula X may optionally comprise any one or more of a signal sequence for secreting the polypeptide to an extracellular location and a secretion-enhancing sequence.

In some embodiments, polypeptides comprising an amino acid sequence according to formula X have any one or more activities selected from the group consisting of enhanced luminescence, stronger flash signal intensity, enhanced glow signal intensity, enhanced stability of glow signal and enhanced effective temperature range, including elevated optimal temperature range, for operation of the enzyme as compared to a reference luciferase polypeptide that has 1, 2 or three fewer amino acid sequences represented by formula XI.

In a related aspect, the present invention provides isolated, synthetic, recombinant or purified nucleic acid molecules that comprise, consist or consist essentially of a nucleotide sequence encoding the amino acid sequence of a polypeptide according to formula VIII as broadly described above. In some embodiments, the nucleic acid molecules comprise, consist or consist essentially of a nucleotide sequence selected from the group consisting of:

(a) a nucleotide sequence that encodes an amino acid sequence selected from any one of: 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788;

(b) a nucleotide sequence selected from any one of SEQ ID NO: 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787;

(c) a nucleotide sequence that shares at least 70% (and at least 71% to at least 99% and all integer percentages in between) sequence identity with the sequence set forth in any one of SEQ ID NO: 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or a complement thereof, wherein the amino acid sequence encoded by the nucleotide sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above; or (c) a nucleotide sequence that hybridizes under at least low, medium or high stringency conditions to the sequence set forth in any one of SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79 or 81, or a complement thereof, wherein the amino acid sequence encoded by the nucleotide sequence comprises at least one subsequence corresponding to $B_1C_5X_{18}X_{19}$, $X_{37}C_6X_{38}X_{39}$ or $X_{41}C_9\Sigma X_{42}$ of formula X, wherein an individual subsequence consists of an amino acid sequence represented by formula XI as defined above.

In some embodiments, the polypeptide encoded by the nucleic acid molecule as broadly described above has any one or more activities selected from the group consisting of enhanced luminescence, stronger flash signal intensity, enhanced glow signal intensity, enhanced stability of glow signal and enhanced effective temperature range, including elevated optimal temperature range, for operation of the enzyme as compared to a reference luciferase polypeptide that has 1, 2 or three fewer amino acid sequences represented by formula XI.

In some embodiments, the nucleic acid molecules further comprise a nucleotide sequence encoding a signal peptide, representative examples of which are selected from:

(a) a nucleotide sequence that encodes an amino acid sequence selected from SEQ ID NO: 84, 86, 88, 90, 92, 94, 96, 98, 100, 102 or 104;

(b) a nucleotide sequence as set forth in any one of SEQ ID NO: 83, 85, 87, 89, 91, 93, 95, 97, 99, 101 or 103, or a complement thereof;

(c) a nucleotide sequence that shares at least 70% (and at least 71% to at least 99% and all integer percentages in between) sequence identity with the sequence set forth in any one of SEQ ID NO: 83, 85, 87, 89, 91, 93, 95, 97, 99, 101 or 103, or a complement thereof; or (d) a nucleotide sequence that hybridizes under at least low, medium or high stringency conditions to the sequence set forth in any one of SEQ ID NO: 83, 85, 87, 89, 91, 93, 95, 97, 99, 101 or 103, or a complement thereof.

In some embodiments, the nucleic acid molecules further comprise a nucleotide sequence encoding a secretion-enhancing sequence, representative examples of which are selected from:

(a) a nucleotide sequence that encodes an amino acid sequence as set forth in any one of SEQ ID NO: 106, 107, 108, 110, 112, 114, 116, 118, 120, 122, 124, 126, 128, 130 or 132; or;

(b) a nucleotide sequence as set forth in any one of SEQ ID NO: 105, 107, 109, 111, 113, 115, 117, 119, 121, 123, 125, 127, 129 or 131, or a complement thereof;

(b) a nucleotide sequence that shares at least 70% (and at least 71% to at least 99% and all integer percentages in between) sequence identity with the sequence set forth in any one of SEQ ID NO: 105, 107, 109, 111, 113, 115, 117, 119, 121, 123, 125, 127, 129 or 131, or a complement thereof; or (c) a nucleotide sequence that hybridizes under at least low, medium or high stringency conditions to the sequence set forth in any one of SEQ ID NO: 105, 107, 109, 111, 113, 115, 117, 119, 121, 123, 125, 127, 129 or 131, or a complement thereof.

In another aspect, the present invention provides polypeptides, which are suitably in isolated, synthetic, recombinant or purified form, which comprise, consist or consist essentially of an amino acid sequence having luciferase activity, wherein the amino acid sequence corresponds to a copepod luciferase amino acid sequence comprising or consisting essentially of the following optimal temperature range-elevating amino acids:

L, or modified form thereof, at at least one position corresponding to positions 85 or 98 (relative to the consensus numbering shown in FIG. 1); and, a basic amino acid residue immediately upstream of at least one conserved cysteine selected from $C_5$, $C_6$, $C_9$ and $C_{10}$ to yield a BC motif.

In some embodiments, the polypeptides comprise (1) L, or modified form thereof, at position 85 (relative to the consensus numbering shown in FIG. 1). In some embodiments, the polypeptides comprise (2) L, or modified form thereof, at position 98 (relative to the consensus numbering shown in FIG. 1). Suitably, the polypeptides comprise (3) L, or modified form thereof, at position 85 and 98 (relative to the consensus numbering shown in FIG. 1).

In some embodiments, the polypeptides comprise (4) a BC motif at at least one position corresponding to conserved cysteines $C_6$ and $C_9$. In representative examples of this type, the polypeptides comprise (5) a BC motif at a position corresponding to conserved cysteine $C_6$. In other representative examples, the polypeptides comprise (6) a BC motif at a position corresponding to conserved cysteine $C_9$. In still other representative examples, the polypeptides comprise (7) a BC motif at positions corresponding to each of conserved cysteines $C_6$ and $C_9$.

In some embodiments, the polypeptides comprise (8) a BCΩ motif at at least one position corresponding to conserved cysteines $C_5$, $C_6$ and $C_9$. In representative examples of this type, the polypeptides comprise (9) a BCΩ motif at a position corresponding to conserved cysteine $C_5$. In other representative examples, the polypeptides comprise (10) a BCΩ motif at a position corresponding to conserved cysteine $C_6$. In still other representative examples, the polypeptides comprise (11) a BCΩ motif at a position corresponding to conserved cysteine $C_9$. In still other representative examples, the polypeptides comprise (12) a BCΩ motif at positions corresponding to each of conserved cysteines $C_5$ and $C_6$. In still other representative examples, the polypeptides comprise (13) a BCΩ motif at positions corresponding to each of conserved cysteines $C_5$ and $C_9$. In still other representative examples, the polypeptides comprise (14) a BCΩ motif at positions corresponding to each of conserved cysteines $C_6$ and $C_9$. In still other representative examples, the polypeptides comprise (15) a BCΩ motif at positions corresponding to each of conserved cysteines $C_5$, $C_6$ and $C_9$.

In some embodiments, the polypeptides comprise (16) a BCΩΩ motif at at least one position corresponding to conserved cysteines $C_5$, $C_6$ and $C_9$. In representative examples of this type, the polypeptides comprise (17) a BCΩΩ motif at a position corresponding to conserved cysteine $C_5$. In other representative examples, the polypeptides comprise (18) a BCΩΩ motif at a position corresponding to conserved cysteine $C_6$. In still other representative examples, the polypeptides comprise (19) a BCΩΩ motif at a position corresponding to conserved cysteine $C_9$. In still other representative examples, the polypeptides comprise (20) a BCΩΩ motif at positions corresponding to each of conserved cysteines $C_5$ and $C_6$. In still other representative examples, the polypeptides comprise (21) a BCΩΩ motif at positions corresponding to each of conserved cysteines $C_5$ and $C_9$. In still other representative examples, the polypeptides comprise (22) a BCΩΩ motif at positions corresponding to each of conserved cysteines $C_6$ and $C_9$. In other representative examples, the polypeptides comprise (23) a BCΩΩ motif at positions corresponding to each of conserved cysteines $C_5$, $C_6$ and $C_9$.

In some embodiments, the polypeptides comprise (24) a BCΩD motif at at least one position corresponding to conserved cysteines $C_5$, $C_6$, $C_9$ and $C_{10}$. In representative examples of this type, the polypeptides comprise (25) a BCΩD motif at a position corresponding to conserved cysteine $C_5$. In other representative examples, the polypeptides comprise (26) a BCΩD motif at a position corresponding to conserved cysteine $C_6$. In still other representative examples, the polypeptides comprise (27) a BCΩD motif at a position corresponding to conserved cysteine $C_9$. In other representative examples, the polypeptides comprise (28) a BCΩD motif at a position corresponding to conserved cysteine $C_{10}$. In still other representative examples, the polypeptides comprise (29) a BCΩD motif at positions corresponding to each of conserved cysteines $C_5$ and $C_6$. In still other representative examples, the polypeptides comprise (30) a BCΩD motif at positions corresponding to each of conserved cysteines $C_5$ and $C_9$. In other representative examples, the polypeptides comprise (31) a BCΩD motif at positions corresponding to each of conserved cysteines $C_5$ and $C_{10}$. In still other representative examples, the polypeptides comprise (32) a BCΩD motif at positions corresponding to each of conserved cysteines $C_6$ and $C_9$. In still other representative examples, the polypeptides comprise (33) a BCΩD motif at positions corresponding to each of conserved cysteines $C_6$ and $C_{10}$. In still other representative examples, the polypeptides comprise (34) a BCΩD motif at positions corresponding to each of conserved cysteines $C_9$ and $C_{10}$. In other representative examples, the polypeptides comprise (35) a BCΩD motif at positions corresponding to each of conserved cysteines $C_5$, $C_6$ and $C_9$. In still other representative examples, the polypeptides comprise (36) a BCΩD motif at positions corresponding to each of conserved cysteines $C_5$, $C_6$ and $C_{10}$. In still other representative examples, the polypeptides comprise (37) a BCΩD motif at positions corresponding to each of conserved cysteines $C_5$, $C_9$ and $C_{10}$. In other representative examples, the polypeptides comprise (38) a BCΩD motif at positions corresponding to each of conserved cysteines $C_6$, $C_9$ and $C_{10}$. In still other representative examples, the polypeptides comprise (39) a BCΩD motif at positions corresponding to each of conserved cysteines $C_5$, $C_6$, $C_9$ and $C_{10}$.

In some embodiments, the polypeptides comprise (40) an EBC motif at at least one position corresponding to conserved cysteines $C_5$, $C_6$, $C_9$ and $C_{10}$. In representative examples of this type, the polypeptides comprise (41) an EBC motif at a position corresponding to conserved cysteine $C_5$. In other representative examples, the polypeptides comprise (42) an EBC motif at a position corresponding to conserved cysteine $C_6$. In still other representative examples, the polypeptides comprise (43) an EBC motif at a position corresponding to conserved cysteine $C_9$. In other representative examples, the polypeptides comprise (44) an EBC motif at a position corresponding to conserved cysteine $C_{10}$. In still other representative examples, the polypeptides comprise (45) an EBC motif at positions corresponding to each of conserved cysteines $C_5$ and $C_6$. In still other representative examples, the polypeptides comprise (46) an EBC motif at positions corresponding to each of conserved cysteines $C_5$ and $C_9$. In other representative examples, the polypeptides comprise (47) an EBC motif at positions corresponding to each of conserved cysteines $C_5$ and $C_{10}$. In still other representative examples, the polypeptides comprise (48) an EBC motif at positions corresponding to each of conserved cysteines $C_6$ and $C_9$. In still other representative examples, the polypeptides comprise (49) an EBC motif at positions corresponding to each of conserved cysteines $C_6$ and $C_{10}$. In still other representative examples, the polypeptides comprise (50) an EBC motif at positions corresponding to each of conserved cysteines $C_9$ and $C_{10}$. In other representative examples, the polypeptides comprise (51) an EBC motif at positions corresponding to each of conserved cysteines $C_5$, $C_6$ and $C_9$. In still other representative examples, the polypeptides comprise (52) an EBC motif at positions corresponding to each of conserved cysteines $C_5$, $C_6$ and $C_{10}$. In still other representative examples, the polypeptides comprise (53) an EBC motif at positions corresponding to each of conserved cysteines $C_5$, $C_9$ and $C_{10}$. In other representative examples, the polypeptides comprise (54) an EBC motif at positions corresponding to each of conserved cysteines $C_6$, $C_9$ and $C_{10}$. In still other representative examples, the polypeptides comprise (55) an EBC motif at positions corresponding to each of conserved cysteines $C_5$, $C_6$, $C_9$ and $C_{10}$.

In some embodiments, the polypeptides comprise (56) a GBC motif at at least one position corresponding to conserved cysteines $C_6$, $C_9$ and $C_{10}$. In representative examples of this type, the polypeptides comprise (57) a GBC motif at a position corresponding to conserved cysteine $C_6$. In other representative examples, the polypeptides comprise (58) a GBC motif at a position corresponding to conserved cysteine $C_9$. In still other representative examples, the polypeptides comprise (59) a GBC motif at a position corresponding to conserved cysteine $C_{10}$. In still other representative examples, the polypeptides comprise (60) a GBC motif at positions corresponding to each of conserved cysteines $C_6$ and $C_9$. In still other representative examples, the polypeptides comprise (61) a GBC motif at positions corresponding to each of conserved cysteines $C_6$ and $C_{10}$. In still other representative examples, the polypeptides comprise (62) a GBC motif at positions corresponding to each of conserved cysteines $C_9$ and $C_{10}$. In still other representative examples, the polypeptides comprise (63) a GBC motif at positions corresponding to each of conserved cysteines $C_6$, $C_9$ and $C_{10}$.

In some embodiments, the polypeptides comprise (64) a BCA motif at at least one position corresponding to conserved cysteines $C_5$, $C_6$ and $C_9$. In representative examples of this type, the polypeptides comprise (65) a BCA motif at a position corresponding to conserved cysteine $C_5$. In other representative examples, the polypeptides comprise (66) a BCA motif at a position corresponding to conserved cysteine $C_6$. In still other representative examples, the polypeptides comprise (67) a BCA motif at a position corresponding to conserved cysteine $C_9$. In still other representative examples, the polypeptides comprise (68) a BCA motif at positions corresponding to each of conserved cysteines $C_5$ and $C_6$. In still other representative examples, the polypeptides comprise (69) a BCA motif at positions corresponding to each of conserved cysteines $C_5$ and $C_9$. In still other representative examples, the polypeptides comprise (70) a BCA motif at positions corresponding to each of conserved cysteines $C_6$ and $C_9$. In still other representative examples, the polypeptides comprise (71) a BCA motif at positions corresponding to each of conserved cysteines $C_5$, $C_6$ and $C_9$.

In some embodiments, the polypeptides comprise (72) a BCAΩ motif at at least one position corresponding to conserved cysteines $C_5$, $C_6$ and $C_9$. In representative examples of this type, the polypeptides comprise (73) a BCAΩ motif at a position corresponding to conserved cysteine $C_5$. In other representative examples, the polypeptides comprise (74) a BCAΩ motif at a position corresponding to conserved cysteine $C_6$. In still other representative examples, the polypeptides comprise (75) a BCAΩ motif at a position corresponding to conserved cysteine $C_9$. In still other representative examples, the polypeptides comprise (76) a BCAΩ motif at positions corresponding to each of conserved cysteines $C_5$ and $C_6$. In still other representative examples, the polypeptides comprise (77) a BCAΩ motif at positions corresponding to each of conserved cysteines $C_5$ and $C_9$. In still other representative examples, the polypeptides comprise (78) a BCAΩ motif at positions corresponding to each of conserved cysteines $C_6$ and $C_9$. In still other representative examples, the polypeptides comprise (79) a BCAΩ motif at positions corresponding to each of conserved cysteines $C_5$, $C_6$ and $C_9$.

In some embodiments, the polypeptides comprise (80) a XBC motif at a position corresponding to conserved cysteine $C_{10}$ wherein X is other than D or P, and is selected, for example, from R or K or modified form thereof, more suitably H or modified form thereof, even more suitably T, A, S or N or modified form thereof, preferably Q or modified form thereof, more preferably G or modified form thereof, even more preferably E or modified form thereof.

Suitably, the polypeptides comprise at least one amino acid as defined in (1) to (3) and a motif as defined in any one of (4) to (7). In other embodiments, the polypeptides comprise at least one amino acid as defined in (1) to (3) and a motif as defined in any one of (8) to (15). In still other embodiments, the polypeptides comprise at least one amino acid as defined in (1) to (3) and a motif as defined in any one of (16) to (23). In still other embodiments, the polypeptides comprise at least one amino acid as defined in (1) to (3) and a motif as defined in any one of (24) to (39). In still other embodiments, the polypeptides comprise at least one amino acid as defined in (1) to (3) and a motif as defined in any one of (40) to (55). In still other embodiments, the polypeptides comprise at least one amino acid as defined in (1) to (3) and a motif as defined in any one of (56) to (63). In other embodiments, the polypeptides comprise at least one amino acid as defined in (1) to (3) and a motif as defined in any one of (64) to (71). In still other embodiments, the polypeptides comprise at least one amino acid as defined in (1) to (3) and a motif as defined in any one of (72) to (79). In still other embodiments, the polypeptides comprise at least one amino acid as defined in (1) to (3) and a motif as defined in (80).

In some embodiments, the polypeptides further comprise a deletion in whole or in part of a reference copepod luciferase amino acid sequence, wherein the amino acid sequence spans downstream of the signal peptide sequence and upstream of the amino acid residue at position 85 (relative to the consensus numbering shown in FIG. 1), suitably upstream of about residue 84, 83, 82, 81, 80, 79, 78, 77, 76, 75, 74, 73, 72, 71 (relative to the consensus numbering shown in FIG. 1).

In some embodiments, the copepod amino acid sequence comprises, consists or consists essentially of the amino acid sequence as defined in formula I or a sequence that shares at least 70% (and at least 71% to at least 99% and all integer percentages in between) sequence similarity or sequence identity with the amino acid sequence represented by formula I.

Still another aspect of the present invention provides methods for preparing a luciferase polypeptide with improved light-emitting characteristics (e.g., improved luminescence, improved flash signal intensity, improved glow signal intensity, improved glow signal stability and improved effective temperature range, including elevated optimal temperature range, of luciferase function). These methods generally comprise preparing an amino acid sequence that is distinguished from a reference luciferase polypeptide sequence, suitably a copepod luciferase polypeptide sequence, by at least one modification selected from the group consisting of:

i) substitution of an amino acid residue at position 85 (relative to the consensus numbering shown in FIG. 1) with L or modified form thereof;

ii) deletion in whole or in part of an amino acid sequence of the reference luciferase polypeptide, wherein the amino acid sequence spans downstream of the signal peptide sequence and upstream of the amino acid residue at position 85 (relative to the consensus numbering shown in FIG. 1), suitably upstream of about residue 84, 83, 82, 81, 80, 79, 78, 77, 76, 75, 74, 73, 72, 71 (relative to the consensus numbering shown in FIG. 1);

iii) substitution of one or more amino acid residues adjacent to at least one conserved cysteine of the reference luciferase polypeptide to produce an amino acid subsequence represented by formula XI:

BCΩD (XI)

wherein:

B is selected from basic amino acid residues (e.g., R or K, or modified form thereof);

C is a conserved cysteine, or modified form thereof, selected from $C_5$, $C_6$ and $C_9$;

Ω is selected from small amino acid residues (e.g., A, S or T, or modified form thereof) or acidic amino acid residues (e.g., E, or modified form thereof); and D is aspartate or modified form thereof;

iv) substitution of one or more amino acid residues adjacent to conserved cysteine $C_{10}$ of the reference luciferase polypeptide to produce an amino acid subsequence as represented by the sequence XRCAS, wherein X is suitably other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof;

v) substitution of one or more amino acid residues adjacent to at least one conserved cysteine selected from $C_5$, $C_6$, $C_9$ and $C_{10}$ of the reference luciferase polypeptide, wherein the substitution at an individual conserved cysteine produces an amino acid sequence represented by formula XX:

BC (XX)

wherein:

B is selected from basic amino acid residues (e.g., R or K, or modified form thereof); and C is a conserved cysteine, or modified form thereof, selected from $C_5$, $C_6$, $C_9$ and $C_{10}$, or in specific embodiments selected from $C_6$ and $C_9$, wherein the substitution at an individual conserved cysteine, in specific embodiments, produces an amino acid sequence represented by formula XXI:

BCΩ (XXI)

wherein:

B is selected from basic amino acid residues (e.g., R or K, or modified form thereof);

C is a conserved cysteine, or modified form thereof, selected from $C_5$, $C_6$, $C_9$ and $C_{10}$; and Ω is selected from small amino acid residues (e.g., A, S or T, or modified form thereof) or acidic amino acid residues (e.g., E, or modified form thereof), wherein the amino acid sequence represented by formula XXI is suitably selected from BCA or BCE, wherein the substitution at an individual conserved cysteine, in specific embodiments, produces an amino acid sequence represented by formula V:

BCΩΩ (V)

wherein:

B is selected from basic amino acid residues (e.g., R or K, or modified form thereof);

C is a conserved cysteine, or modified form thereof, selected from $C_5$, $C_6$ $C_9$ and $C_{10}$; and Ω is selected from small amino acid residues (e.g., A, S or T, or modified form thereof) or acidic amino acid residues (e.g., E, or modified form thereof), wherein the amino acid sequence represented by formula V is selected, for example, from BCAD (e.g., RCAD, KCAD), BCAT (e.g., RCAT, KCAT), BCED (e.g., RCED, KCED), BCSD (e.g., RCSD, KCSD), BCTD (e.g., RCTD, KCTD), and BCAS (e.g., RCAS, KCAS), wherein the substitution adjacent to conserved cysteines $C_5$ or $C_6$ results for example in an amino acid sequence selected from RCAD, KCAD, RCED, KCED, RCSD, KCSD, RCTD and KCTD, wherein the substitution adjacent to $C_9$ results for example in an amino acid sequence consisting of KCSD;

wherein the substitutions adjacent to one or both conserved cysteines selected from $C_6$ and $C_{10}$, in specific embodiments, produces an amino acid sequence represented by formula XXIII:

EBC (XXIII)

wherein:

B is selected from basic amino acid residues (e.g., R or K, or modified form thereof); and C is a conserved cysteine, or modified form thereof, selected from $C_6$ and $C_9$, wherein the substitution adjacent to conserved cysteine $C_{10}$, in specific embodiments, produces an amino acid sequence represented by formula XXIV:

GBC (XXIV)

wherein:

B is selected from basic amino acid residues (e.g., R or K, or modified form thereof); and C is conserved cysteine $C_{10}$, or modified form thereof, wherein the substitution adjacent to one or both conserved cysteines selected from $C_5$ and $C_{10}$, in specific embodiments, produces an amino acid sequence represented by formula XXV:

GBCΩ (XXV)

wherein:

B is selected from basic amino acid residues (e.g., R or K, or modified form thereof);

C is a conserved cysteine, or modified form thereof, selected from $C_5$ and $C_{10}$; and Ω is selected from small amino acid residues (e.g., A, S or T, or modified form thereof) or acidic amino acid residues (e.g., E, or modified form thereof), wherein GBCΩ is represented, for example, by GBCA, wherein the substitution adjacent to one or both conserved cysteines selected from $C_5$ and $C_{10}$, in specific embodiments, produces an amino acid sequence represented by formula XXVI:

GBCΩΩ (XXVI)

wherein:

B is selected from basic amino acid residues (e.g., R or K, or modified form thereof);

C is a conserved cysteine, or modified form thereof, selected from $C_5$ and $C_{10}$; and Ω is selected from small amino acid residues (e.g., A, S or T, or modified form thereof) or acidic amino acid residues (e.g., E, or modified form thereof), wherein GBCΩΩ is represented for example by GBCAT.

In advantageous embodiments, the modifications according to any one of i) to v) as defined herein elevate the optimal temperature range, including the optimal temperature, of luciferase function and are also referred to herein as "optimal temperature range-elevating modifications" or "optimal temperature-elevating modifications."

Suitably, the methods comprise modifying the reference polypeptide, wherein the modification results in the preparation of a modified luciferase comprising at least 1, 2, 3, 4, 5 modifications as defined in i) to v) above. Illustrative combinations of modifications are listed in Table A below.

TABLE A

| | ii) | iii) | iv) | v) |
|---|---|---|---|---|
| i) | ■ | ■ | ■ | ■ |
| ii) | | ■ | ■ | ■ |
| iii) | | | ■ | ■ |
| iv) | | | | ■ |
| i), ii) | | ■ | ■ | ■ |
| i), iii) | | | ■ | ■ |
| i), iv) | | | | ■ |
| ii), iii) | | | ■ | ■ |
| ii), iv) | | | | ■ |
| iii), iv) | | | | ■ |
| i), ii), iii) | | | ■ | ■ |
| i), ii), iv); | | | | ■ |
| i), iii), iv) | | | | ■ |
| ii), iii), iv) | | | | ■ |
| i), ii), iii), iv) | | | | ■ |

In some embodiments, a copepod amino acid sequence is used as basis for the modification and suitably comprises, consists or consists essentially of the amino acid sequence as defined in formula I or a sequence that shares at least 70% (and at least 71% to at least 99% and all integer percentages in between) sequence similarity or sequence identity with the amino acid sequence represented by formula I.

In specific embodiments, the at least one modification is selected from the group consisting of:

L, or modified form thereof, at at least one position corresponding to positions 85 or 98 (relative to the consensus numbering shown in FIG. 1);

a basic amino acid residue immediately upstream of at least one conserved cysteine selected from $C_5$, $C_6$, $C_9$ and $C_{10}$ to yield a BC motif; and a deletion in whole or in part of the reference copepod luciferase amino acid sequence, wherein the amino acid sequence spans downstream of the signal peptide sequence and upstream of the amino acid residue at position 85 (relative to the consensus numbering shown in FIG. 1), suitably upstream of about residue 84, 83, 82, 81, 80, 79, 78, 77, 76, 75, 74, 73, 72, 71 (relative to the consensus numbering shown in FIG. 1).

In some of these embodiments, the polypeptides comprise (1) L, or modified form thereof, at position 85 (relative to the consensus numbering shown in FIG. 1). In some embodiments, the polypeptides comprise (2) L, or modified form thereof, at position 98 (relative to the consensus numbering shown in FIG. 1). Suitably, the polypeptides comprise (3) L, or modified form thereof, at position 85 and 98 (relative to the consensus numbering shown in FIG. 1).

In some of these embodiments, the polypeptides comprise (4) a BC motif at at least one position corresponding to conserved cysteines $C_6$ and $C_9$. In representative examples of this type, the polypeptides comprise (5) a BC motif at a position corresponding to conserved cysteine $C_6$. In other representative examples, the polypeptides comprise (6) a BC motif at a position corresponding to conserved cysteine $C_9$. In still other representative examples, the polypeptides comprise (7) a BC motif at positions corresponding to each of conserved cysteines $C_6$ and $C_9$.

In some of these embodiments, the polypeptides comprise (8) a BCΩ motif at at least one position corresponding to conserved cysteines $C_5$, $C_6$ and $C_9$. In representative examples of this type, the polypeptides comprise (9) a BCΩ motif at a position corresponding to conserved cysteine $C_5$. In other representative examples, the polypeptides comprise (10) a BCΩ motif at a position corresponding to conserved cysteine $C_6$. In still other representative examples, the polypeptides comprise (11) a BCΩ motif at a position corresponding to conserved cysteine $C_9$. In still other representative examples, the polypeptides comprise (12) a BCΩ motif at positions corresponding to each of conserved cysteines $C_5$ and $C_6$. In still other representative examples, the polypeptides comprise (13) a BCΩ motif at positions corresponding to each of conserved cysteines $C_5$ and $C_9$. In still other representative examples, the polypeptides comprise (14) a BCΩ motif at positions corresponding to each of conserved cysteines $C_6$ and $C_9$. In still other representative examples, the polypeptides comprise (15) a BCΩ motif at positions corresponding to each of conserved cysteines $C_5$, $C_6$ and $C_9$.

In some of these embodiments, the polypeptides comprise (16) a BCΩΩ motif at at least one position corresponding to conserved cysteines $C_5$, $C_6$ and $C_9$. In representative examples of this type, the polypeptides comprise (17) a BCΩΩ motif at a position corresponding to conserved cysteine $C_5$. In other representative examples, the polypeptides comprise (18) a BCΩΩ motif at a position corresponding to conserved cysteine $C_6$. In still other representative examples, the polypeptides comprise (19) a BCΩΩ motif at a position corresponding to conserved cysteine $C_9$. In still other representative examples, the polypeptides comprise (20) a BCΩΩ motif at positions corresponding to each of conserved cysteines $C_5$ and $C_6$. In still other representative examples, the polypeptides comprise (21) a BCΩΩ motif at positions corresponding to each of conserved cysteines $C_5$ and $C_9$. In still other representative examples, the polypeptides comprise (22) a BCΩΩ motif at positions corresponding to each of conserved cysteines $C_6$ and $C_9$. In other representative examples, the polypeptides comprise (23) a BCΩΩ motif at positions corresponding to each of conserved cysteines $C_5$, $C_6$ and $C_9$.

In some of these embodiments, the polypeptides comprise (24) a BCΩD motif at at least one position corresponding to conserved cysteines $C_5$, $C_6$, $C_9$ and $C_{10}$. In representative examples of this type, the polypeptides comprise (25) a BCΩD motif at a position corresponding to conserved cysteine $C_5$. In other representative examples, the polypeptides comprise (26) a BCΩD motif at a position corresponding to conserved cysteine $C_6$. In still other representative examples, the polypeptides comprise (27) a BCΩD motif at a position corresponding to conserved cysteine $C_9$. In other representative examples, the polypeptides comprise (28) a BCΩD motif at a position corresponding to conserved cysteine $C_{10}$. In still other representative examples, the polypeptides comprise (29) a BCΩD motif at positions corresponding to each of conserved cysteines $C_5$ and $C_6$. In still other representative examples, the polypeptides comprise (30) a BCΩD motif at positions corresponding to each of conserved cysteines $C_5$ and $C_9$. In other representative examples, the polypeptides comprise (31) a BCΩD motif at positions corresponding to each of conserved cysteines $C_5$ and $C_{10}$. In still other representative examples, the polypeptides comprise (32) a BCΩD motif at positions corresponding to each of conserved cysteines $C_6$ and $C_9$. In still other representative examples, the polypeptides comprise (33) a BCΩD motif at positions corresponding to each of conserved cysteines $C_6$ and $C_{10}$. In still other representative examples, the polypeptides comprise (34) a BCΩD motif at positions corresponding to each of conserved cysteines $C_9$ and $C_{10}$. In other representative examples, the polypeptides comprise (35) a BCΩD motif at positions corresponding to each of conserved cysteines $C_5$, $C_6$ and $C_9$. In still other representative examples, the polypeptides comprise (36) a BCΩD motif at positions corresponding to each of conserved cysteines $C_5$, $C_6$ and $C_{10}$. In still other representative examples, the polypeptides comprise (37) a BCΩD motif at positions corresponding to each of conserved cysteines $C_5$, $C_9$ and $C_{10}$. In other representative examples, the polypeptides comprise (38) a BCΩD motif at positions corresponding to each of conserved cysteines $C_6$, $C_9$ and $C_{10}$. In still other representative examples, the polypeptides comprise (39) a BCΩD motif at positions corresponding to each of conserved cysteines $C_5$, $C_6$, $C_9$ and $C_{10}$.

In some of these embodiments, the polypeptides comprise (40) an EBC motif at at least one position corresponding to conserved cysteines $C_5$, $C_6$, $C_9$ and $C_{10}$. In representative examples of this type, the polypeptides comprise (41) an EBC motif at a position corresponding to conserved cysteine $C_5$. In other representative examples, the polypeptides comprise (42) an EBC motif at a position corresponding to conserved cysteine $C_6$. In still other representative examples, the polypeptides comprise (43) an EBC motif at a position corresponding to conserved cysteine $C_9$. In other representative examples, the polypeptides comprise (44) an EBC motif at a position corresponding to conserved cysteine $C_{10}$. In still other representative examples, the polypeptides comprise (45) an EBC motif at positions corresponding to each of conserved cysteines $C_5$ and $C_6$. In still other representative examples, the polypeptides comprise (46) an EBC motif at positions corresponding to each of conserved cysteines $C_5$ and $C_9$. In other representative examples, the polypeptides comprise (47) an EBC motif at positions corresponding to each of conserved cysteines $C_5$ and $C_{10}$. In still other representative examples, the polypeptides comprise (48) an EBC motif at positions corresponding to each of conserved cysteines $C_6$ and $C_9$. In still other representative examples, the polypeptides comprise (49) an EBC motif at positions corresponding to each of conserved cysteines $C_6$ and $C_{10}$. In still other representative examples, the polypeptides comprise (50) an EBC motif at positions corresponding to each of conserved cysteines $C_9$ and $C_{10}$. In other representative examples, the polypeptides comprise (51) an EBC motif at positions corresponding to each of conserved cysteines $C_5$, $C_6$ and $C_9$. In still other representative examples, the polypeptides comprise (52) an EBC motif at positions corresponding to each of conserved cysteines $C_5$, $C_6$ and $C_{10}$. In still other representative examples, the polypeptides comprise (53) an EBC motif at positions corresponding to each of conserved cysteines $C_5$, $C_9$ and $C_{10}$. In other representative examples, the polypeptides comprise (54) an EBC motif at positions corresponding to each of conserved cysteines $C_6$, $C_9$ and $C_{10}$. In still other representative examples, the polypeptides comprise (55) an EBC motif at positions corresponding to each of conserved cysteines $C_5$, $C_6$, $C_9$ and $C_{10}$.

In some of these embodiments, the polypeptides comprise (56) a GBC motif at at least one position corresponding to conserved cysteines $C_6$, $C_9$ and $C_{10}$. In representative examples of this type, the polypeptides comprise (57) a GBC motif at a position corresponding to conserved cysteine $C_6$. In other representative examples, the polypeptides comprise (58) a GBC motif at a position corresponding to conserved cysteine $C_9$. In still other representative examples, the polypeptides comprise (59) a GBC motif at a position corresponding to conserved cysteine $C_{10}$. In still other representative examples, the polypeptides comprise (60) a GBC motif at positions corresponding to each of conserved cysteines $C_6$ and $C_9$. In still other representative examples, the polypeptides comprise (61) a GBC motif at positions corresponding to each of conserved cysteines $C_6$ and $C_{10}$. In still other representative examples, the polypeptides comprise (62) a GBC motif at positions corresponding to each of conserved cysteines $C_9$ and $C_{10}$. In still other representative examples, the polypeptides comprise (63) a GBC motif at positions corresponding to each of conserved cysteines $C_6$, $C_9$ and $C_{10}$.

In some of these embodiments, the polypeptides comprise (64) a BCA motif at at least one position corresponding to conserved cysteines $C_5$, $C_6$ and $C_9$. In representative examples of this type, the polypeptides comprise (65) a BCA motif at a position corresponding to conserved cysteine $C_5$. In other representative examples, the polypeptides comprise (66) a BCA motif at a position corresponding to conserved cysteine $C_6$. In still other representative examples, the polypeptides comprise (67) a BCA motif at a position corresponding to conserved cysteine $C_9$. In still other representative examples, the polypeptides comprise (68) a BCA motif at positions corresponding to each of conserved cysteines $C_5$ and $C_6$. In still other representative examples, the polypeptides comprise (69) a BCA motif at positions corresponding to each of conserved cysteines $C_5$ and $C_9$. In still other representative examples, the polypeptides comprise (70) a BCA motif at positions corresponding to each of conserved cysteines $C_6$ and $C_9$. In still other representative examples, the polypeptides comprise (71) a BCA motif at positions corresponding to each of conserved cysteines $C_5$, $C_6$ and $C_9$.

In some of these embodiments, the polypeptides comprise (72) a BCAΩ motif at at least one position corresponding to conserved cysteines $C_5$, $C_6$ and $C_9$. In representative examples of this type, the polypeptides comprise (73) a BCAΩ motif at a position corresponding to conserved cysteine $C_5$. In other representative examples, the polypeptides comprise (74) a BCAΩ motif at a position corresponding to conserved cysteine $C_6$. In still other representative examples, the polypeptides comprise (75) a BCAΩ motif at a position corresponding to conserved cysteine $C_9$. In still other representative examples, the polypeptides comprise (76) a BCAΩ motif at positions corresponding to each of conserved cysteines $C_5$ and $C_6$. In still other representative examples, the polypeptides comprise (77) a BCAΩ motif at positions corresponding to each of conserved cysteines $C_5$ and $C_9$. In still other representative examples, the polypeptides comprise (78) a BCAΩ motif at positions corresponding to each of conserved cysteines $C_6$ and $C_9$. In still other representative examples, the polypeptides comprise (79) a BCAΩ motif at positions corresponding to each of conserved cysteines $C_5$, $C_6$ and $C_9$.

In some of these embodiments, the polypeptides comprise (80) a XBC motif at a position corresponding to conserved cysteine $C_{10}$ wherein X is other than D or P, and is selected, for example, from R or K or modified form thereof, more suitably H or modified form thereof, even more suitably T, A, S or N or modified form thereof, preferably Q or modified form thereof, more preferably G or modified form thereof, even more preferably E or modified form thereof.

In some of these embodiments, the polypeptides comprise (81) a deletion in whole or in part of the reference copepod luciferase amino acid sequence, wherein the amino acid sequence spans downstream of the signal peptide sequence and upstream of the amino acid residue at position 85 (relative to the consensus numbering shown in FIG. 1), suitably upstream of about residue 84, 83, 82, 81, 80, 79, 78, 77, 76, 75, 74, 73, 72, 71 (relative to the consensus numbering shown in FIG. 1).

Suitably, the polypeptides comprise at least one amino acid as defined in (1) to (3) and a motif as defined in any one of (4) to (7). In other embodiments, the polypeptides comprise at least one amino acid as defined in (1) to (3) and a motif as defined in any one of (8) to (15). In still other embodiments, the polypeptides comprise at least one amino acid as defined in (1) to (3) and a motif as defined in any one of (16) to (23). In still other embodiments, the polypeptides comprise at least one amino acid as defined in (1) to (3) and a motif as defined in any one of (24) to (39). In still other embodiments, the polypeptides comprise at least one amino acid as defined in (1) to (3) and a motif as defined in any one of (40) to (55). In still other embodiments, the polypeptides comprise at least one amino acid as defined in (1) to (3) and a motif as defined in any one of (56) to (63). In other embodiments, the polypeptides comprise at least one amino acid as defined in (1) to (3) and a motif as defined in any one of (64) to (71). In still other embodiments, the polypeptides comprise at least one amino acid as defined in (1) to (3) and a motif as defined in any one of (72) to (79). In still other embodiments, the polypeptides comprise at least one amino acid as defined in (1) to (3) and a motif as defined in (80). In still other embodiments, the polypeptides comprise at least one amino acid as defined in (1) to (3) and a deletion as defined in (81). In other embodiments, the polypeptides comprise a motif as defined in any one of (4) to (8) and a deletion as defined in (81). In still other embodiments, the polypeptides comprise at least one amino acid as defined in (1) to (3), a motif as defined in any one of (4) to (8) and a deletion as defined in (81).

In a related aspect, the present invention provides methods for preparing a modified copepod luciferase polypeptide with an elevated optimal temperature range, including an elevated optimal temperature, of luciferase function. These methods generally comprise preparing a modified copepod luciferase polypeptide such that it comprises, consists or consists essentially of an amino acid sequence that is distinguished from a reference copepod luciferase polypeptide by at least one amino acid sequence modification, wherein the at least one amino acid sequence modification is selected on the basis that it elevates the optimal temperature range of luciferase function relative to the reference copepod luciferase polypeptide.

Suitably, the at least one effective temperature range-elevating modification is selected from the group consisting of modifications i) to v) as defined infra. In illustrative examples of this type, the reference polypeptide is modified to include at least 1, 2, 3, 4, 5 modifications according to i) to xi) as defined herein, and as for example illustrated in Table A.

In some embodiments, the at least one modification elevates the optimal temperature range, including optimal temperature, of luciferase function by at least 2, 3, 4, 5, 6, 7, 8, 9, 10, 11, 12, 13, 14, 15, 16, 17, 18, 19, 20, 21, 22, 23, 24, 25, 26, 27, 28, 29, 30° C. In illustrative examples of this type, the at least one modification elevates the optimal temperature range of luciferase function to. Suitably, the at least one modification elevates the optimal temperature of luciferase function to 20, 21, 22, 23, 24, 25, 26, 27, 28, 29, 30, 31, 32, 33, 34, 35, 36, 37, 38, 39 or 40° C. In specific embodiments, the at least one modification results in enhanced luciferase activity at 37° C. In other specific embodiments, the at least one modification results in enhanced luciferase activity at room temperature (e.g., 22° C.).

In some embodiments, the methods comprise modifying the reference polypeptide so that it includes an L or modified form thereof at position 85 (relative to the consensus numbering shown in FIG. 1).

Suitably, the methods further comprise determining the activity of the polypeptide so prepared (e.g., strength of flash signal intensity, strength of glow signal intensity, glow signal stability and effective temperature range, including elevated optimal temperature range, of luciferase function).

In some embodiments, the methods further comprise comparing the activity of the polypeptide to the activity of the reference luciferase polypeptide.

Non-limiting reference luciferase polypeptide sequences may be selected from:

[SEQ ID NO:2] (full-length sequence of *Gaussia princeps* Prolume luciferase);

[SEQ ID NO:4] (full-length sequence of *Gaussia princeps* Prolume KDEL luciferase);

[SEQ ID NO:6] (full-length sequence of *Gaussia princeps* Mutant 1 luciferase);

[SEQ ID NO:8] (full-length sequence of *Gaussia princeps* Mutant 2 luciferase);

[SEQ ID NO:10] (full-length sequence of *Gaussia princeps* GS luciferase);

[SEQ ID NO:166] (full-length sequence of *Metridia pacifica* 2bv1 luciferase);

[SEQ ID NO:168] (full-length sequence of *Metridia pacifica* 2bv2 luciferase);

[SEQ ID NO:170] (full-length sequence of *Metridia longa* 22 luciferase);

[SEQ ID NO:172] (full-length sequence of *Metridia longa* 39 luciferase);

[SEQ ID NO: 790]
MGVKLIFAVLCVAAAQAATINENFEDIDVVAIGGSFALDVDANRGGHGGH
PGKKMPKEVLVEMEANAKRAGCHRGCLICLSHIKCTKKMKKFIPGRCHSYEGDKDSAQGGIG
EEIVDMPEIPGFKDKEPMDQFIAQVDLCVDCTTGCLKGLANVHCSALLKKWLPSRCKTFASKI
QSQVDTIKGLAGDR
(full-length sequence of *Metridia pacifica* 2a luciferase, also referred to herein as MP2a);

[SEQ ID NO: 792]
MMEIQVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSALLKKWLPDRCASFADKIQSEVDNIKGLAGDR
(full-length sequence of *Metridia pacifica* 1v1 luciferase, also referred to herein as MP1v1);

[SEQ ID NO: 794]
MMEIKVLFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSALLKKWLPDRCASFADKIQSEVDNIKGLAGDR
(full-length sequence of *Metridia pacifica* 1v2 luciferase, also referred to herein as MP1v2);

[SEQ ID NO: 796]
MMEVKVVFALICFALVQANPTENKDDIDIVGVEGKFGTTDLETDLFTIVED
MNVISRDTNLANSDADRGKMPGKKLPLEVLIEMEANARKAGCTRGCLICLSKIKCTAKMKV
YIPGRCHDYGGDKKTGQAGIVGAIVDIPEISGFKELGPMEQFIAQVDLCADCTTGCLKGLANV
KCSALLKKWLPDRCASFADKIQSEVDNIKGLAGDR
(full-length sequence of *Metridia pacifica* 1v3 luciferase, also referred to herein as MP1v3);

[SEQ ID NO: 798]
MDIKFIFALVCIALVQANPTVNNDVNRGKMPGKKLPLEVLIEMEANAFKA
GCTRGCLICLSKIKCTAKMKQYIPGRCHDYGGDKKTGQAGIVGAIVDIPEISGFKEMEPMEQFI
AQVDLCADCTTGCLKGLANVKCSELLKKWLPDRCASFADKIQKEAHNIKGLAGDR
(full-length sequence of *Metridia longa* 7 luciferase, also referred to herein as ML7);

[SEQ ID NO: 800]
MKTDIADTDRASNFVATETDANRGKMPGKKLPLAVIMEMEANAFKAGCT
RGCLICLSKIKCTAKMKVYIPGRCHDYGGDKKTGQAGIVGAIVDIPEISGFKEMAPMEQFIAQ
VDRCASCTTGCLKGLANVKCSELLKKWLPDRCASFADKIQKEVHNIKGMAGDR
(full-length sequence of *Metridia longa* GS luciferase, also referred to herein as MLGS);

[SEQ ID NO: 802]
MDIKVVFTLVFSALVQAQKTDIADTDRASNFVATETDANRGKMPGKKLPL
AVIMEMEANAFKAGCTRGCLICLSKIKCTAKMKVYIPGRCHDYGGDKKTGQAGIVGAIVDIP
EISGFKEMAPMEQFIAQVDRCASCTTGCLKGLANVKCSELLKKWLPDRCASFADKIQKEVHN
IKGMAGDR
(full-length sequence of *Metridia longa* 164M3 luciferase, also referred to herein as ML164M3);

[SEQ ID NO: 804]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVDRCASCTTG
CLKGLANVKCSELLKKWLPDRCASFADKIQKEVHNIKGMAGDR
(full-length sequence of *Metridia longa* 164v1 luciferase, also referred to herein as ML164v1);

[SEQ ID NO: 806]
MDIKVVFTLVFSALVQAKSTEFDPNIDIVGLEGKFGITNLETDLFTIWETME
VMIKADIADTDRASNFVATETDANRGKMPGKKLPLAVIMEMEANAFKAGCTRGCLICLSKIK
CTAKMKVYIPGRCHDYGGDKKTGQAGIVGAIVDIPEISGFKEMAPMEQFIAQVERCASCTTGC
LKGLANVKCSELLKKWLPDRCASFADKIQKEVHNIKGMAGDR
(full-length sequence of *Metridia longa* 164v2 luciferase, also referred to herein as ML164v2);

[SEQ ID NO: 808]
MDMKVIFALIFSALVQAKSTEFDPNIDIVGLEGKFGITNLETDLFTIWETME
VIKSDIADTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDRCTSCTTGCL
KGLANVKCSELLKKWLPDRCASFADKIQKEVHNIKGMAGDR
(full-length sequence of luciferase *Metridia longa* 16 luciferase, also referred to herein as ML16);

[SEQ ID NO: 810]
MDIKVVFALVFSALVQAKSTEFDPNIDIVGLEGKFGITNLETDLFTIWETME
VIKTDIADTDRARSFVATETDANRGKMPGKKLPLAVIMEMEANAFKAGCTRGCLICLSKIKCT

-continued

```
AKMKVYIPGRCHDYGGDKKTGQAGIVGAIVDIPEISGFKEMEPMEQFIAQVDRCASCTTGCL
KGLANVKCSELLKKWLPDRCASFADKIQKEVHNIKGMAGDR
(full-length sequence of Metridia longa 45 luciferase, also
referred to herein as ML45);

                                                     [SEQ ID NO: 812]
MDIKVVFALVFSALVQAKSTEFDPNIDVVGLEGKFGITNLETDLFTIWETM
EVIKTDIADTDRARNFVATETDANRGKMPGKKLPLAVIMEMEANAFKAGCTRGCLICLSKIK
CTAKMKVYIPGRCHDYGGDKKTGQAGIVGAIVDIPEISGFKEMEPMEQFIAQVDRCASCNTG
CLKGLANVKCSELLKKWLPDRCASFADKIQKEVHNIKGMAGDR
(full-length sequence of Metridia longa 52 luciferase, also
referred to herein as ML52)
and

                                                     [SEQ ID NO: 814]
MDMRVIFALVFSSLVQAKSTEFDPNINIVGLEGKFGITNLETDLFTIWETMD
VIKSDITDTDRVSNFVATETDANRGKMPGKKLPLAVIMEMEANAFKAGCTRGCLICLSKIKCT
AKMKVYIPGRCHDYGGDKKTGQAGIVGAIVDIPEISGFKEMAPMEQFIAQVDLCATCTTGCL
KGLANVKCSELLKKWLPGRCASFADKIQKEVHNIKGMAGDR
(full-length sequence of Metridia longa AL luciferase, also
referred to herein as MLAL).
```

In a related aspect, the invention provides

Another related aspect of the present invention provides constructs comprising a nucleic acid molecule as broadly described above, operably connected to a regulatory sequence.

In yet another aspect, the present invention provides host cells containing a construct as broadly described above.

In still another aspect, the present invention provides methods for evaluating the activity of a reporter enzyme associated with a cell, wherein the reporter enzyme comprises, consists or consists essentially of a polypeptide as broadly described above, with improved light-emitting characteristics (e.g., improved luminescence, improved flash signal intensity, improved glow signal intensity, improved glow signal stability and improved effective temperature range, including elevated optimal temperature range, of luciferase function). These methods generally comprise: (a) contacting the cell with coelenterazine or an analogue or derivative thereof (e.g., benzy-coelenterazine; bisdeoxy-coelenterazine; coelenterazine, h-coelenterazine, f-coelenterazine, cl-coelenterazine, n-coelenterazine, cp-coelenterazine, ch-coelenterazine, hch-coelenterazine, fch-coelenterazine, e-coelenterazine, ef-coelenterazine, ech-coelenterazine, hcp-coelenterazine, and the like); and (b) detecting a signal generated from the coelenterazine or an analogue or derivative thereof to evaluate the activity of the reporter enzyme. In some embodiments, the detection is carried within the improved effective temperature range, including the elevated optimal temperature range, of luciferase function. In some embodiments, the cell contains a nucleic acid molecule as broadly described above.

In yet another aspect, the present invention provides kits comprising: a container comprising a polypeptide as broadly described above, or a nucleic acid molecule as broadly described above, or a construct as broadly described above, or a cell as broadly described above. In some embodiments, the kits further comprise a container comprising a luciferin, which is suitably lyophilized.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

DETAILED DESCRIPTION OF THE INVENTION

1. Definitions

Figure 1:
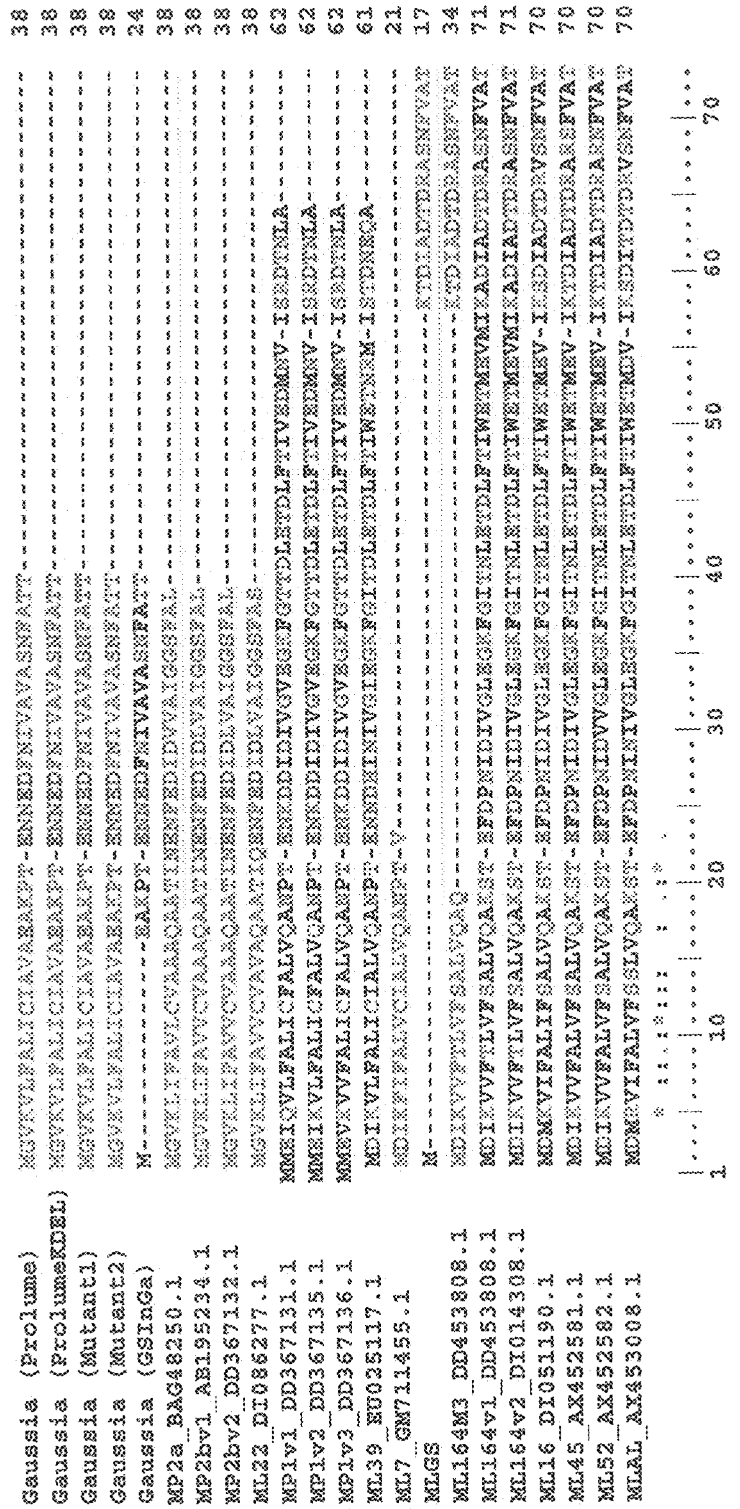
FIG. 1 is diagrammatic representation showing the results of a sequence alignment of the following putatively full-length luciferase amino acid sequences: [SEQ ID NO: 2] (*Gaussia princeps* Prolume luciferase); [SEQ ID NO:4] (*Gaussia princeps* Prolume KDEL luciferase); [SEQ ID NO:6] (*Gaussia princeps* Mutant 1 luciferase); [SEQ ID NO: 8] (*Gaussia princeps* Mutant 2 luciferase); [SEQ ID NO: 10] (*Gaussia princeps* GS luciferase); [SEQ ID NO: 166] (*Metridia pacifica* 2bv1 luciferase); [SEQ ID NO: 168] (*Metridia pacifica* 2bv2 luciferase); [SEQ ID NO: 170] (Metridia longa 22 luciferase); [SEQ ID NO: 172] (*Metridia longa*39 luciferase); [SEQ ID NO: 790] (*Metridia pacifica* 2a luciferase); [SEQ ID NO: 792] (*Metridia pacifica* 1v1 luciferase); [SEQ ID NO: 794] (*Metridia pacifica* 1v2 luciferase); [SEQ ID NO: 796] (*Metridia pacifica* 1v3 luciferase); [SEQ ID NO: 798] (*Metridia longa*7 luciferase); [SEQ ID NO: 800] (*Metridia longa* GS luciferase); [SEQ ID NO: 802] (*Metridia longa* 164M3 luciferase); [SEQ ID NO: 804] (*Metridia longa* 164v1 luciferase); [SEQ ID NO: 806] (*Metridia longa*164v2 luciferase); [SEQ ID NO: 808] (luciferase Metridia longa 16luciferase); [SEQ ID NO: 810] (*Metridia longa* 45luciferase); [SEQ ID NO: 812] (*Metridia longa* 52 luciferase); [SEQ ID NO: 814] (*Metridia longa* AL luciferase); and a consensus sequence SEQ ID NO: 905.
Figure 1:
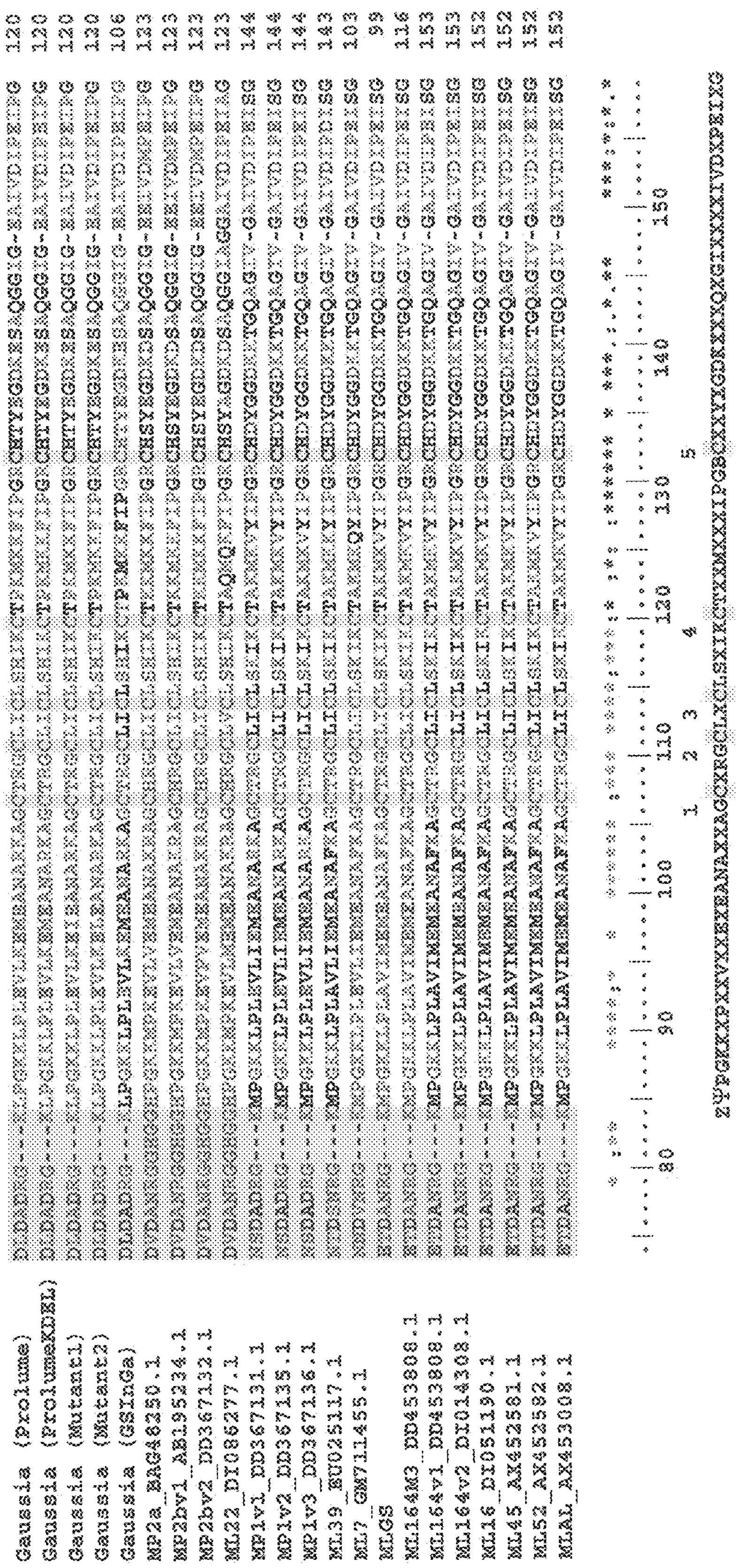

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e. to at least one) of the grammatical object of the article. By way of example, "an element" means one element or more than one element.

By "about" is meant a quantity, level, value, number, frequency, percentage, dimension, size, amount, weight, position or length that varies by as much 15, 14, 13, 12, 11, 10, 9, 8, 7, 6, 5, 4, 3, 2 or 1% to a reference quantity, level, value, number, frequency, percentage, dimension, size, amount, weight, position or length.

The term "biologically active fragment," as applied to fragments of a reference or full-length polynucleotide or polypeptide sequence, refers to a fragment that has at least about 0.1, 0.5, 1, 2, 5, 10, 12, 14, 16, 18, 20, 22, 24, 26, 28, 30, 35, 40, 45, 50, 55, 60, 65, 70, 75, 80, 85, 90, 95, 96, 97, 98, 99% of the activity of a reference sequence. Included within the scope of the present invention are biologically active fragments of at least about 40, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200 residues in length or 120, 150, 180, 210, 240, 270, 300, 330, 360 390, 420, 450, 480, 510, 540, 570, 600 nucleotides in length, which fragments comprise or encode an activity of a reference polynucleotide or polypeptide. Representative biologically active fragments generally participate in an interaction, e.g., an intra-molecular or an inter-molecular interaction. For example, biologically active portions of a luciferase polypeptide according to the present invention (e.g., peptide or polypeptide) include polypeptides comprising amino acid sequences with sufficient similarity or identity to or derived from the amino acid sequence of the luciferase polypeptides of the present invention and comprise at least one activity selected from luminescence, flash signal, glow signal, stability of glow signal and enhanced effective temperature range, including elevated optimal temperature range, of the enzyme.

As used herein, the term "cis-acting sequence" or "cis-regulatory region" or similar term shall be taken to mean any sequence of nucleotides which is derived from an expressible genetic sequence wherein the expression of the genetic sequence is regulated, at least in part, by the sequence of nucleotides. Those skilled in the art will be aware that a cis-regulatory region may be capable of activating, silencing, enhancing, repressing or otherwise altering the level of expression and/or cell-type-specificity and/or developmental specificity of any structural gene sequence.

As used herein, a "chimeric construct" refers to a polynucleotide having heterologous nucleic acid elements. Chimeric constructs include "expression cassettes" or "expression constructs," which refer to an assembly that is capable of directing the expression of the sequence(s) or gene(s) of interest (e.g., a luciferase coding sequence). An expression cassette generally includes control elements such as a promoter that is operably linked to (so as to direct transcription of) a synthetic polynucleotide of the invention, and often includes a polyadenylation sequence as well. Within certain embodiments of the invention, the chimeric construct may be contained within a vector. In addition to the components of the chimeric construct, the vector may include, one or more selectable markers, a signal which allows the vector to exist as single-stranded DNA (e.g., a M13 origin of replication), at least one multiple cloning site, and a "mammalian" origin of replication (e.g., a SV40 or adenovirus origin of replication).

By "coding sequence" is meant any nucleic acid sequence that contributes to the code for the polypeptide product of a gene. By contrast, the term "non-coding sequence" refers to any nucleic acid sequence that does not contribute to the code for the polypeptide product of a gene.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands.

Throughout this specification, unless the context requires otherwise, the words "comprise," "comprises" and "comprising" will be understood to imply the inclusion of a stated step or element or group of steps or elements but not the exclusion of any other step or element or group of steps or elements. Thus, use of the term "comprising" and the like indicates that the listed elements are required or mandatory, but that other elements are optional and may or may not be present. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

By "corresponds to" or "corresponding to" is meant an amino acid sequence that displays substantial sequence similarity or identity to a reference amino acid sequence In general an amino acid sequence that corresponds to a reference amino acid sequence will display at least about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence similarity or identity to at least a portion of the reference amino acid sequence.

By "gene" is meant a unit of inheritance that occupies a specific locus on a chromosome and consists of transcriptional and/or translational regulatory sequences and/or a coding region and/or non-translated sequences (i.e., introns, 5' and 3' untranslated sequences).

The term "host cell" includes an individual cell or cell culture that can be or has been a recipient of any recombinant construct(s) or isolated polynucleotide of the invention. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo or in vitro with a recombinant construct or a polynucleotide of the invention. A host cell, which comprises a recombinant construct of the invention, is a recombinant host cell.

"Hybridization" is used herein to denote the pairing of complementary nucleotide sequences to produce a DNA-DNA hybrid or a DNA-RNA hybrid. Complementary base sequences are those sequences that are related by the base-pairing rules. In DNA, A pairs with T and C pairs with G. In RNA U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently.

By "isolated" is meant material that is substantially or essentially free from components that normally accompany it in its native state. For example, an "isolated polynucleotide," as used herein, refers to a polynucleotide, which has been purified from the sequences that flank it in a naturally occurring state, e.g., a DNA fragment, which has been removed from the sequences that are normally adjacent to the fragment. Alternatively, an "isolated peptide" or an "isolated polypeptide" and the like, as used herein, refer to in vitro isolation and/or purification of a polypeptide molecule from its natural cellular environment, and from association with other components of the cell, i.e., it is not associated with in vivo substances. Similarly, an "isolated" or "purified" proteinaceous molecule (e.g., peptide, polypeptide, protein etc) is substantially free of cellular material or other contaminating molecules from the cell or tissue source from which the proteinaceous molecule is derived, or substantially free from chemical precursors or other chemicals when chemically synthesized. "Substantially free" means that a preparation of a luciferase polypeptide according to the invention is at least 10, 15, 20, 25, 30, 35, 40, 45, 50, 55, 60, 65, 70, 75, 80, 85, 90, 91, 92, 93, 94, 95, 96, 97, 98 or 99% pure. In a preferred embodiment, the preparation of luciferase polypeptide has less than about 30, 25, 20, 15, 10, 9, 8, 7, 6, 5, 4, 3, 2 or 1% (by dry weight), of non-luciferase polypeptides (also referred to herein as a "contaminating molecules"), or of chemical precursors or non-luciferase chemicals. When the luciferase polypeptide is recombinantly produced, it is also desirably substantially free of culture medium, i.e., culture medium represents less than about 20, 15, 10, 5, 4, 3, 2, 1% of the volume of the luciferase preparation. The invention includes isolated or purified preparations of at least 0.01, 0.1, 1.0, and 10 milligrams in dry weight.

The term "luminescence" refers to the light output of a luciferase polypeptide under appropriate conditions, e.g., in the presence of a suitable substrate such as a coelenterazine. The light output may be measured as an instantaneous or near-instantaneous measure of light output (typically in seconds, which is sometimes referred to as "T=0" luminescence or "flash") upon start of the luminescence reaction, which may start upon addition of the coelenterazine substrate. The luminescence reaction in various embodiments is carried out in a solution containing lysate, for example from the cells in a prokaryotic or eukaryotic expression system; in other embodiments, expression occurs in an in vitro system or the luciferase protein is secreted into an extracellular medium, such that, in this latter case, it is not necessary to produce a lysate. In some embodiments, the reaction is started by injecting appropriate materials (e.g., coelenterazine) into a reaction chamber (e.g., a well of a multi-well plate such as a 96-well plate) containing the luciferase protein. The reaction chamber may be situated in a reading device that can measure the light output, e.g., using a luminometer or photomultiplier. The light output or luminescence may also be measured over time, for example in the same reaction chamber for minutes, hours, etc. (which is sometimes referred to as "glow"). The light output or luminescence may be reported as the average over time, the half-life of decay of signal, the sum of the signal over a period of time, or as the peak output. Enhanced luminescence includes increased light output or luminescence, determined by suitable comparison of comparably obtained measurements. As disclosed herein, one or more suitable amino acid modifications to copepod luciferase sequences produce modified luciferase polypeptides with enhanced luminescence. Changes in the nucleotide sequence from a wild-type or other parent copepod luciferase nucleotide sequence may contribute to enhanced luminescence by leading to an amino acid substitution and/or by enhancing protein expression. Enhanced signal stability includes an increase in how long the signal from a luciferase continues to luminesce ("glow"), for example, as measured by the half-life of decay of the signal in a time-course. Enhanced effective temperature range for luciferase operation includes a broader temperature range at which luminescence assays can be performed whilst maintaining suitable signal strength; i.e., without substantial temperature-dependent loss in signal strength. For example, the luciferase displays minimal or insubstantial changes in activity in response to temperature fluctuations across a broader range of temperatures (e.g., above or below room temperature). Enhanced effective temperature range also includes within its scope modifying a luciferase's temperature range so that it can perform at or about the intended temperature of an assay to be performed (e.g., at or about 37° C. for an in vivo assay that is performed within a living mammal or at or about room temperature (RT; ~22° C.) for a bench-top assay or at or about 4° C. for assays such as immunoassays performed in a fridge or cold room in order to minimize degradation of essential reaction components in the sample and/or assay reagents). In advantageous embodiments of this type, the luciferase's temperature range (including optimal temperature) is elevated as compared to its temperature range (or optimal temperature) before modification or to a control or reference luciferase, when measured under the same reaction conditions. The precise optimal temperature may vary according to a reaction condition, such as a reaction solution, but the elevation in temperature range (including optimal temperature) of a luciferase would be readily apparent to one of ordinary skill in the art when measured under given buffer conditions, such as those described herein. The term "optimal temperature range" as used herein refers to the range of temperatures in which a luciferase exhibits a signal strength of at least 80% of the signal strength at its optimal temperature. An "elevated optimal temperature range" means a temperature range comprising a higher upper threshold temperature as compared to the upper threshold temperature of the optimal temperature range of a reference luciferase.

The term "5' non-coding region" is used herein in its broadest context to include all nucleotide sequences which are derived from the upstream region of an expressible gene, other than those sequences which encode amino acid residues which comprise the polypeptide product of the gene, wherein 5' non-coding region confers or activates or otherwise facilitates, at least in part, expression of the gene.

The term "operably connected" or "operably linked" as used herein means placing a structural gene under the regulatory control of a regulatory element including but not limited to a promoter, which then controls the transcription and optionally translation of the gene. In the construction of heterologous promoter/structural gene combinations, it is generally preferred to position the genetic sequence or promoter at a distance from the gene transcription start site that is approximately the same as the distance between that genetic sequence or promoter and the gene it controls in its natural setting; i.e. the gene from which the genetic sequence or promoter is derived. As is known in the art, some variation in this distance can be accommodated without loss of function. Similarly, the preferred positioning of a regulatory sequence element with respect to a heterologous gene to be placed under its control is defined by the positioning of the element in its natural setting; i.e. the genes from which it is derived.

The term "oligonucleotide" as used herein refers to a polymer composed of a multiplicity of nucleotide residues (deoxyribonucleotides or ribonucleotides, or related structural variants or synthetic analogues thereof) linked via phosphodiester bonds (or related structural variants or synthetic analogues thereof). Thus, while the term "oligonucleotide" typically refers to a nucleotide polymer in which the nucleotide residues and linkages between them are naturally occurring, it will be understood that the term also includes within its scope various analogues including, but not restricted to, peptide nucleic acids (PNAs), phosphoramidates, phosphorothioates, methyl phosphonates, 2-O-methyl ribonucleic acids, and the like. The exact size of the molecule can vary depending on the particular application. An oligonucleotide is typically rather short in length, generally from about 10 to 30 nucleotide residues, but the term can refer to molecules of any length, although the term "polynucleotide" or "nucleic acid" is typically used for large oligonucleotides.

The term "polynucleotide" or "nucleic acid" as used herein designates mRNA, RNA, cRNA, cDNA or DNA. The term typically refers to polymeric form of nucleotides of at least 10 bases in length, either ribonucleotides or deoxynucleotides or a modified form of either type of nucleotide. The term includes single and double stranded forms of DNA.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains the biological function or activity of the reference polynucleotide. The terms "polynucleotide variant" and "variant" also include naturally occurring allelic variants.

"Polypeptide," "peptide," "protein" and "proteinaceous molecule" are used interchangeably herein to refer to molecules comprising or consisting of a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. This term also includes within its scope two or more complementing or interactive polypeptides comprising different parts or portions (e.g., polypeptide domains, polypeptide chains etc.) of a luciferase polypeptide of the present invention, wherein the individual complementing polypeptides together reconstitute the activity of the different parts or portions to form a functional luciferase polypeptide. Such complementing polypeptides are used routinely in protein complementation assays, which are well known to persons skilled in the art.

The terms "peptide variant" and "polypeptide variant" and the like refer to polypeptides that are distinguished from a reference polypeptide by the addition, deletion or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Peptide and polypeptide variants also encompass polypeptides in which one or more amino acids have been added or deleted, or replaced with different amino acid residues.

By "primer" is meant an oligonucleotide which, when paired with a strand of DNA, is capable of initiating the synthesis of a primer extension product in the presence of a suitable polymerizing agent. The primer is preferably single-stranded for maximum efficiency in amplification but can alternatively be double-stranded. A primer must be sufficiently long to prime the synthesis of extension products in the presence of the polymerization agent. The length of the primer depends on many factors, including application, temperature to be employed, template reaction conditions, other reagents, and source of primers. For example, depending on the complexity of the target sequence, the oligonucleotide primer typically contains 15 to 35 or more nucleotide residues, although it can contain fewer nucleotide residues. Primers can be large polynucleotides, such as from about 200 nucleotide residues to several kilobases or more. Primers can be selected to be "substantially complementary" to the sequence on the template to which it is designed to hybridize and serve as a site for the initiation of synthesis. By "substantially complementary", it is meant that the primer is sufficiently complementary to hybridize with a target polynucleotide. Preferably, the primer contains no mismatches with the template to which it is designed to hybridize but this is not essential. For example, non-complementary nucleotide residues can be attached to the 5' end of the primer, with the remainder of the primer sequence being complementary to the template. Alternatively, non-complementary nucleotide residues or a stretch of non-complementary nucleotide residues can be interspersed into a primer, provided that the primer sequence has sufficient complementarity with the sequence of the template to hybridize therewith and thereby form a template for synthesis of the extension product of the primer.

"Probe" refers to a molecule that binds to a specific sequence or sub-sequence or other moiety of another molecule. Unless otherwise indicated, the term "probe" typically refers to a polynucleotide probe that binds to another polynucleotide, often called the "target polynucleotide", through complementary base pairing. Probes can bind target polynucleotides lacking complete sequence complementarity with the probe, depending on the stringency of the hybridization conditions. Probes can be labeled directly or indirectly.

The term "recombinant polynucleotide" as used herein refers to a polynucleotide formed in vitro by the manipulation of nucleic acid into a form not normally found in nature. For example, the recombinant polynucleotide may be in the form of an expression vector. Generally, such expression vectors include transcriptional and translational regulatory nucleic acid operably linked to the nucleotide sequence.

By "recombinant polypeptide" is meant a polypeptide made using recombinant techniques, i.e., through the expression of a recombinant polynucleotide.

By "regulatory element" or "regulatory sequence" is meant nucleic acid sequences (e.g., DNA) necessary for expression of an operably linked coding sequence in a particular host cell. The regulatory sequences that are suitable for prokaryotic cells for example, include a promoter, and optionally a cis-acting sequence such as an operator sequence and a ribosome binding site. Control sequences that are suitable for eukaryotic cells include promoters, polyadenylation signals, transcriptional enhancers, translational enhancers, leader or trailing sequences that modulate mRNA stability, as well as targeting sequences that target a product encoded by a transcribed polynucleotide to an intracellular compartment within a cell or to the extracellular environment.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I, U) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. The present invention contemplates the use in the methods and systems of the present invention of full-length luciferase polypeptides as well as their biologically active fragments. Typically, biologically active fragments of a full-length luciferase polypeptide may participate in an interaction, for example, an intra-molecular or an inter-molecular interaction. An inter-molecular interaction can be a specific binding interaction or an enzymatic interaction (e.g., the interaction can be transient and a covalent bond is formed or broken). Biologically active fragments of a full-length luciferase polypeptide include peptides comprising amino acid sequences sufficiently similar to or derived from the amino acid sequences of a (putative) full-length luciferase polypeptide. Typically, biologically active fragments comprise a domain or motif with at least one activity selected from: luminescence, flash signal, glow signal, stability of glow signal and effective temperature range, including elevated optimal temperature range, of flash signal or glow signal. A biologically active fragment of a full-length luciferase polypeptide can be a polypeptide which is, for example, 40, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200 or more amino acid residues in length. Suitably, the biologically-active fragment has no less than about 1%, 10%, 25% 50% of an activity of the full-length polypeptide from which it is derived.

"Similarity" refers to the percentage number of amino acids that are identical or constitute conservative substitutions as defined in Tables 2 and 3 infra. Similarity may be determined using sequence comparison programs such as GAP (Deveraux et al. 1984, *Nucleic Acids Research* 12: 387-395). In this way, sequences of a similar or substantially different length to those cited herein might be compared by insertion of gaps into the alignment, such gaps being determined, for example, by the comparison algorithm used by GAP.

Terms used to describe sequence relationships between two or more polynucleotides or polypeptides include "reference sequence," "comparison window", "sequence identity," "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

"Stringency" as used herein, refers to the temperature and ionic strength conditions, and presence or absence of certain organic solvents, during hybridization and washing procedures. The higher the stringency, the higher will be the degree of complementarity between immobilized target nucleotide sequences and the labeled probe polynucleotide sequences that remain hybridized to the target after washing. The term "high stringency" refers to temperature and ionic conditions under which only nucleotide sequences having a high frequency of complementary bases will hybridize. The stringency required is nucleotide sequence dependent and depends upon the various components present during hybridization. Generally, stringent conditions are selected to be about 10 to 20° C. lower than the thermal melting point ($T_m$) for the specific sequence at a defined ionic strength and pH. The $T_m$ is the temperature (under defined ionic strength and pH) at which 50% of a target sequence hybridizes to a complementary probe.

The term "synonymous codon" as used herein refers to a codon having a different nucleotide sequence than another codon but encoding the same amino acid as that other codon.

By "vector" is meant a polynucleotide molecule, suitably a DNA molecule derived, for example, from a plasmid, bacteriophage, yeast or virus, into which a polynucleotide can be inserted or cloned. A vector may contain one or more unique restriction sites and can be capable of autonomous replication in a defined host cell including a target cell or tissue or a progenitor cell or tissue thereof, or be integrable with the genome of the defined host such that the cloned sequence is reproducible. Accordingly, the vector can be an autonomously replicating vector, i.e., a vector that exists as an extra-chromosomal entity, the replication of which is independent of chromosomal replication, e.g., a linear or closed circular plasmid, an extra-chromosomal element, a mini-chromosome, or an artificial chromosome. The vector can contain any means for assuring self-replication. Alternatively, the vector can be one which, when introduced into the host cell, is integrated into the genome and replicated together with the chromosome(s) into which it has been integrated. A vector system can comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. In the present case, the vector is preferably a viral or viral-derived vector, which is operably functional in animal and preferably mammalian cells. Such vector may be derived from a poxvirus, an adenovirus or yeast. The vector can also include a selection marker such as an antibiotic resistance gene that can be used for selection of suitable transformants. Examples of such resistance genes are known to those of skill in the art and include the nptII gene that confers resistance to the antibiotics kanamycin and G418 (Geneticin®) and the hph gene that confers resistance to the antibiotic hygromycin B.

The terms "wild-type" and "naturally occurring" are used interchangeably to refer to a gene or gene product that has the characteristics of that gene or gene product when isolated from a naturally occurring source. A wild type gene or gene product (e.g., a polypeptide) is that which is most frequently observed in a population and is thus arbitrarily designed the "normal" or "wild-type" form of the gene.

2. Abbreviations

The following abbreviations are used throughout the application:

nt=nucleotide
nts=nucleotides
aa=amino acid(s)
kb=kilobase(s) or kilobase pair(s)
kDa=kilodalton(s)
d=day
h=hour
s=seconds
w.t.=wild type 3. Modified Luciferases The present invention is based in part on the determination that certain structural elements of luciferases, including luciferases within the copepod luciferase family are important for modulating luciferase function and certain modification of those features can lead to significant improvements to the light-emitting characteristics of luciferases. In particular, the present inventors have found that: (1) an L at position 85 or 98 (relative to the consensus numbering shown in FIG. 1); (2) a truncation, in whole or in part, of a region spanning downstream of the signal peptide sequence and upstream of about residue 85; (3) at least one 4-residue motif, which includes a conserved cysteine (e.g., $C_5$, $C_6$, $C_9$ and $C_{10}$); (4) at least one 2-residue motif, which includes a conserved cysteine (e.g., $C_5$, $C_6$, $C_9$ and $C_{10}$); and/or (5)); at least one 3-residue motif, which includes a conserved cysteine (e.g., $C_5$, $C_6$, $C_9$ and $C_{10}$) can significantly improve one or more light-emitting characteristics or properties of luciferases, including copepod luciferases. Accordingly, the present invention provides methods for improving at least one light-emitting characteristic of a luciferase, including luminescence, flash signal intensity, glow signal intensity, glow signal stability and effective temperature range, including elevated temperature range, of luciferase function. These methods generally comprise preparing an amino acid sequence that is distinguished from a reference luciferase polypeptide sequence by at least one modification selected from:

i) substitution of an amino acid residue at position 85 (relative to the consensus numbering shown in FIG. 1) with L or modified form thereof;

ii) deletion in whole, or in part, of an amino acid sequence of the reference luciferase polypeptide, wherein the amino acid sequence spans downstream of the signal peptide sequence and upstream of the amino acid residue at position 85 (relative to the consensus numbering shown in FIG. 1), suitably upstream of about residue 84, 83, 82, 81, 80, 79, 78, 77, 76, 75, 74, 73, 72, 71 (relative to the consensus numbering shown in FIG. 1);

iii) substitution of one or more amino acid residues adjacent to at least one conserved cysteine (e.g., at any 1, 2, 3 4, 5, 6, 7, 8 or 9 amino acid residues selected from the amino acid residues at positions 143, 145, 146, 193, 195, 196, 210, 212 and 213) of the reference luciferase polypeptide to produce an amino acid subsequence represented by formula XI:

$$BC\Omega D \qquad (XI)$$

wherein:

B is selected from basic amino acid residues (e.g., R or K, or modified form thereof);

C is a conserved cysteine, or modified form thereof, wherein the conserved cysteine in some embodiments is selected from $C_5$, $C_6$ and $C_9$;

Ω is selected from small amino acid residues (e.g., A, S or T, or modified form thereof) or acidic amino acid residues (e.g., E, or modified form thereof); and D is aspartate or modified form thereof;

iv) substitution of one or more amino acid residues adjacent to conserved cysteine $C_{10}$ of the reference luciferase polypeptide to produce an amino acid subsequence as represented by the sequence XRCAS, wherein X is suitably other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof;

v) substitution of one or more amino acid residues adjacent to at least one conserved cysteine selected from $C_5$, $C_6$, $C_9$ and $C_{10}$ of the reference luciferase polypeptide, wherein the substitution at an individual conserved cysteine produces an amino acid sequence represented by formula XX:

$$BC \qquad (XX)$$

wherein:

B is selected from basic amino acid residues (e.g., R or K, or modified form thereof); and C is a conserved cysteine, or modified form thereof, selected from $C_5$, $C_6$, $C_9$ and $C_{10}$, or in specific embodiments selected from $C_6$ and $C_9$, wherein the substitution at an individual conserved cysteine, in specific embodiments, produces an amino acid sequence represented by formula XXI:

BCΩ (XXI)

wherein:

B is selected from basic amino acid residues (e.g., R or K, or modified form thereof);

C is a conserved cysteine, or modified form thereof, selected from $C_5$, $C_6$, $C_9$ and $C_{10}$; and Ω is selected from small amino acid residues (e.g., A, S or T, or modified form thereof) or acidic amino acid residues (e.g., E, or modified form thereof), wherein the amino acid sequence represented by formula XXI is suitably selected from BCA or BCE, wherein the substitution at an individual conserved cysteine, in specific embodiments, produces an amino acid sequence represented by formula V:

BCΩΩ (V)

wherein:

B is selected from basic amino acid residues (e.g., R or K, or modified form thereof);

C is a conserved cysteine, or modified form thereof, selected from $C_5$, $C_6$ $C_9$ and $C_{10}$; and Ω is selected from small amino acid residues (e.g., A, S or T, or modified form thereof) or acidic amino acid residues (e.g., E, or modified form thereof), wherein the amino acid sequence represented by formula V is selected, for example, from BCAD (e.g., RCAD, KCAD), BCAT (e.g., RCAT, KCAT), BCED (e.g., RCED, KCED), BCSD (e.g., RCSD, KCSD), BCTD (e.g., RCTD, KCTD), and BCAS (e.g., RCAS, KCAS), wherein the substitution adjacent to conserved cysteines $C_5$ or $C_6$ results for example in an amino acid sequence selected from RCAD, KCAD, RCED, KCED, RCSD, KCSD, RCTD and KCTD, wherein the substitution adjacent to $C_9$ results for example in an amino acid sequence consisting of KCSD;

wherein the substitutions adjacent to one or both conserved cysteines selected from $C_6$ and $C_{10}$, in specific embodiments, produces an amino acid sequence represented by formula XXIII:

EBC (XXIII)

wherein:

B is selected from basic amino acid residues (e.g., R or K, or modified form thereof); and C is a conserved cysteine, or modified form thereof, selected from $C_6$ and $C_9$, wherein the substitution adjacent to conserved cysteine $C_{10}$, in specific embodiments, produces an amino acid sequence represented by formula XXIV:

GBC (XXIV)

wherein:

B is selected from basic amino acid residues (e.g., R or K, or modified form thereof); and C is conserved cysteine $C_{10}$, or modified form thereof, wherein the substitution adjacent to one or both conserved cysteines selected from $C_5$ and $C_{10}$, in specific embodiments, produces an amino acid sequence represented by formula XXV:

GBCΩ (XXV)

wherein:

B is selected from basic amino acid residues (e.g., R or K, or modified form thereof);

C is a conserved cysteine, or modified form thereof, selected from $C_5$ and $C_{10}$; and Ω is selected from small amino acid residues (e.g., A, S or T, or modified form thereof) or acidic amino acid residues (e.g., E, or modified form thereof), wherein GBCΩ is represented, for example, by GBCA, wherein the substitution adjacent to one or both conserved cysteines selected from $C_5$ and $C_{10}$, in specific embodiments, produces an amino acid sequence represented by formula XXVI:

GBCΩΩ (XXVI)

wherein:

B is selected from basic amino acid residues (e.g., R or K, or modified form thereof);

C is a conserved cysteine, or modified form thereof, selected from $C_5$ and $C_{10}$; and Ω is selected from small amino acid residues (e.g., A, S or T, or modified form thereof) or acidic amino acid residues (e.g., E, or modified form thereof), wherein GBCΩΩ is represented for example by GBCAT.

or a combination of the above modifications, as for example illustrated in Table A infra.

In some embodiments, the modification includes substitution of one or more residues adjacent to conserved cysteine $C_5$ of the reference luciferase polypeptide to produce an amino acid subsequence selected from RCAD, KCAD, RCED, KCED, RCSD, KCSD, RCTD, KCTD, RCAT and RCAS.

In some embodiments, the modification includes substitution of one or more residues adjacent to conserved cysteine $C_6$ of the reference luciferase polypeptide to produce an amino acid subsequence selected from RCAD, KCAD, RCED, KCED, RCSD, KCSD, RCTD and KCTD.

In some embodiments, the modification includes substitution of one or more residues adjacent to conserved cysteine $C_9$ of the reference luciferase polypeptide to produce an amino acid subsequence KCSD.

In some embodiments, the modification may further include substitution of one or more residues adjacent to conserved cysteine $C_{10}$ of the reference luciferase polypeptide to produce an amino acid subsequence as represented by the sequence XRCAS, wherein X is other than D or P and is suitably selected from R or K or modified form thereof, more suitably H or modified form thereof, even more suitably T, A, S or N or modified form thereof, preferably Q or modified form thereof, more preferably G or modified form thereof, even more preferably E or modified form thereof.

Representative reference luciferase polypeptides include those comprising the amino acid sequences as set forth in SEQ ID NO: 2, 4, 6, 8, 10, 166, 168, 170, 172, 790, 792, 794, 796, 798, 800, 802, 804, 806, 808, 810, 812 and 814.

The present invention also contemplates modifying other reference luciferases including synthetic or artificially created luciferases as well as naturally occurring luciferases from luciferase-producing organisms to include at least 1, 2, 3, 4, 5, 6 or more modifications as described herein. In specific embodiments, a reference luciferase is obtained from the sub-class Copepoda, more suitably from luminous genera of a Copepoda family selected from Metridinidae, Lucicutiidae, Heterorhabdidae, Augaptilidae, Megacalanidae Oncaeidae, Aegisthidae, Aetideidae and Pontellidae. Non-limiting examples of luminous organisms from the Metridinidae family include: *Metridinidae* species such as *M. lucens, M. longa, M. princeps, M. norvegica, M. pacifica, M. gerlachei and M. macrura; Pleuromamma* species such as *P. xiphias, P. adbominalis, P. robusta, P. gracilis, P. piseki, P. borealis, P. indica* and *P. quadrangulata*; and *Gaussia* species such as *G. princeps*. Representative examples of luminous organisms from the Lucicutiidae family include: *Lucicutiidae* species such as *L. flavicornis, L. gemina, L. ovalis, L. wolfendeni, L. sarsi, L. aurita, L. clause, L. grandis* and *L. magna*. Illustrative examples of luminous organisms from the Heterorhabdidae family include: *Heterorhabdus* species such as *H. papilliger, H. norvegicus, H. robustus* and *H. spinifrons; Hemirhabdus* species such as *Hemirhabdus grimaldii* and *H. latus; Heterostylites* species such as *Heterostylites longicornis*; and *Desseta* species such as *Dessetapalumbio*. Non-limiting examples of luminous organisms from the Augaptilidae family include: *Euaugaptilus* species such as *E. magnus, E. laticeps, E. perodiosus, E. filiger, E. squamatus, E. nodifrons, E. truncates/vicinus, E. rectus, E. grandicornis, E. farrani* and *E. bullifer; Centraugaptilus* species such as *C. horridus, C. rattrayi* and *C. cucullatus; Haptoptilus* species such as *H. longicirrus; Heteroptilus* species such as *H. acutilobus; Pachyptilus* species such as *P. eurygnathus*. Representative examples of luminous organisms from the Megacalanidae family include: *Megacalanus* species such as *M. princeps*. Illustrative examples of luminous organisms from the Oncaeidae family include: *Oncaea* species such as *O. conifer*. Non-limiting examples of luminous organisms from the Aegisthidae family include: *Aegisthus* species such as *Aegisthusmucronatus*. Representative examples of luminous organisms from the Aetideidae family include: *Chiridius* species such as *C. poppei*. Illustrative examples of luminous organisms from the Pontellidae family include: *Pontella* species such as *P. mimocerami*.

In some embodiments, a luciferase polypeptide of the present invention has any one or more of the following activities: (i) enhanced luminescence, (ii) stronger flash signal intensity, (iii) enhanced glow signal intensity, (iv) enhanced stability of glow signal and (v) enhanced effective temperature range, including elevated optimal temperature range, for operation of the enzyme as compared to a reference luciferase polypeptide lacking the amino acid sequence modifications.

The present invention contemplates full-length luciferase polypeptides as well as their biologically active fragments. Typically, biologically active fragments of a full-length luciferase may participate in an interaction, for example, an intramolecular or an inter-molecular interaction and/or may display any one or more of activities (i) to (v) noted above. Such biologically active fragments include peptides comprising amino acid sequences sufficiently similar to or derived from the amino acid sequences of a (putative) full-length luciferase polypeptide, for example, the amino acid sequences shown in SEQ ID NO: 46, 48, 50, 52, 82, 136, 138, 140, 142, 144, 146, 148, 150, 152, 154, 156, 158, 160 or 162 (i.e., those lacking a signal peptide and secretion-enhancing sequence and directing the polypeptide to an intracellular location), which include less amino acids than a putatively full-length luciferase polypeptide, and which exhibit at least one activity of that polypeptide (e.g., any one or more of activities (i) to (v) defined above. Typically, biologically active fragments will comprise a domain with at least one activity of a putatively full-length luciferase polypeptide and may include an about 140-residue domain beginning at about residue 85 (relative to the consensus numbering shown in FIG. 1) and comprising each of the conserved cysteines ($C_1$-$C_{10}$), as shown for example in FIG. 1. In some embodiments, biologically active fragments will comprise an hydrophobic amino acid residue (e.g., an aliphatic amino acid residue L or M or modified form thereof) at position 85, P or modified form thereof at position 86, G or modified form thereof at position 87, K or modified form thereof at position 88, K or modified form thereof at position 89, an hydrophobic amino acid residue (e.g., aliphatic amino acid residues such as L or M, or modified form thereof) at position 90, P or modified form thereof at position 91, an hydrophobic amino acid residue (e.g., aliphatic amino acid residues such as L, or modified form thereof) or a basic amino acid residue (e.g., K, or modified form thereof) at position 92, an hydrophobic amino acid residue (e.g., aliphatic amino acid residues such as A, or modified form thereof) or an acidic amino acid residue (e.g., E, or modified form thereof) at position 93, V or modified form thereof at position 94, an hydrophobic amino acid residue (e.g., aliphatic amino acid residues such as I or L, or modified form thereof) or a small amino acid residue (e.g., P, or modified form thereof) at position 95, an hydrophobic amino acid residue (e.g., aliphatic amino acid residues such as I, M or V, or modified form thereof) or a basic amino acid residue (e.g., K, or modified form thereof) at position 96, E or modified form thereof at position 97, an hydrophobic amino acid residue (e.g., aliphatic amino acid residues such as M, I or L, or modified form thereof) at position 98, E or modified form thereof at position 99, A or modified form thereof at position 100, N or modified form thereof at position 101, A or modified form thereof at position 102, a basic amino acid residue (e.g., K or R, or modified form thereof) or an hydrophobic amino acid residue (e.g., aromatic amino acid residues such as F, or modified form thereof) at position 103, a basic amino acid residue (e.g., K or R, or modified form thereof) at position 104, A or modified form thereof at position 105, G or modified form thereof at position 106, $C_1$ or modified form thereof at position 107, a small amino acid residue (e.g., T, or modified form thereof) or a basic amino acid residue (e.g., H, or modified form thereof) at position 108, R or modified form thereof at position 109, G or modified form thereof at position 110, $C_2$ or modified form thereof at position 111, L or modified form thereof at position 112, an hydrophobic amino acid residue (e.g., aliphatic amino acid residues such as I or V, or modified form thereof) at position 113, $C_3$ or modified form thereof at position 114, L or modified form thereof at position 115, S or modified form thereof at position 116, a basic amino acid residue (e.g., H or K, or modified form thereof) at position 117, I or modified form thereof at position 118, K or modified form thereof at position 119, $C_4$ or modified form thereof at position 120, T or modified form thereof at position 121, a small amino acid residue (e.g., P or A, or modified form thereof) or a basic amino acid residue (e.g., K, or modified form thereof) at position 122, a basic amino acid residue (e.g., K, or modified form thereof) or a neutral/polar amino acid residue (e.g., Q, or modified form thereof) at position 123, M or modified form thereof at position 124, a basic amino acid residue (e.g., K, or modified form thereof) or a neutral/polar amino acid residue (e.g., Q, or modified form thereof) at position 125, any amino acid residue (e.g., basic amino acid residues such as K, or modified form thereof, hydrophobic amino acid residues including aliphatic amino acid residues such as V, or modified form thereof, or neutral/polar amino acid residues such as Q, or modified form thereof) at position 126, an hydrophobic amino acid residue (e.g., aromatic amino acid residues such as F or Y, or modified form thereof) at position 127, I or modified form thereof at position 128, P or modified form thereof at position 129, G or modified form thereof at position 130, a basic amino acid residue (e.g., R or K, or modified form thereof) at position 131, $C_5$ or modified form thereof at position 132, a basic amino acid residue (e.g., H, or modified form thereof) or a small amino acid residue (e.g., A, or modified form thereof) at position 133, an acidic amino acid residue (e.g., D, or modified form thereof) or a small amino acid residue (e.g., T or S, or modified form thereof) at position 134, Y or modified form thereof at position 135, an acidic amino acid residue (e.g., E, or modified form thereof) or a small amino acid residue (e.g., G or A, or modified form thereof) at position 136, G or modified form thereof at position 137, D or modified form thereof at position 138, K or modified form thereof at position 139, an acidic amino acid residue (e.g., D or E, or modified form thereof) or a basic amino acid residue (e.g., K, or modified form thereof) at position 140, a small amino acid residue (e.g., S or T, or modified form thereof) at position 141, a small amino acid residue (e.g., G or A, or modified form thereof) at position 142, Q or modified form thereof at position 143, a small amino acid residue (e.g., G or A, or modified form thereof) at position 144, G or modified form thereof at position 145, I or modified form thereof at position 146, a small amino acid residue (e.g., G or A, or modified form thereof) or an hydrophobic amino acid residue (e.g., aliphatic amino acid residues such as V, or modified form thereof) at position 147, either no amino acid residue or a small amino acid residue (e.g., G, or modified form thereof) at position 148, an acidic amino acid residue (e.g., E, or modified form thereof) or small amino acid residues (e.g., G, or modified form thereof) at position 149, a small amino acid residue (e.g., A, or modified form thereof) or an acidic amino acid residue (e.g., E, or modified form thereof) at position 150, I or modified form thereof at position 151, V or modified form thereof at position 152, D or modified form thereof at position 153, an hydrophobic amino acid residue (e.g., aliphatic amino acid residues such as I or M, or modified form thereof) at position 154, P or modified form thereof at position 155, E or modified form thereof at position 156, I or modified form thereof at position 157, a small amino acid residue (e.g., P, S or A, or modified form thereof) at position 158, G or modified form thereof at position 159, F or modified form thereof at position 160, K or modified form thereof at position 161, an acidic amino acid residue (e.g., D or E, or modified form thereof) at position 162, an hydrophobic amino acid residue (e.g., aliphatic amino acid residues such as L or M, or modified form thereof) or a basic amino acid residue (e.g., K, or modified form thereof) at position 163, a charged amino acid residue (e.g., acidic amino acid residues such as E, or modified form thereof, or basic amino acid residues such as K, or modified form thereof) or a small amino acid residue (e.g., G or A, or modified form thereof) at position 164, P or modified form thereof at position 165, an hydrophobic amino acid residue (e.g., aliphatic amino acid residues such as M or L, or modified form thereof) at position 166, an acidic amino acid residue (e.g., E or D, or modified form thereof) at position 167, Q or modified form thereof at position 168, F or modified form thereof at position 169, I or modified form thereof at position 170, A or modified form thereof at position 171, Q or modified form thereof at position 172, V or modified form thereof at position 173, an acidic amino acid residue (e.g., D or E, or modified form thereof) at position 174, an hydrophobic amino acid residue (e.g., aliphatic amino acid residues such as L, or modified form thereof) or a basic amino acid residue (e.g., R, or modified form thereof) at position 175, $C_6$ or modified form thereof at position 176, any amino acid residue (e.g., hydrophobic amino acid residues including aliphatic amino acid residues such as V, or modified form thereof, or small amino acid residues such as A or T, or modified form thereof, or acidic amino acid residues such as E, or modified form thereof) at position 177, an acidic amino acid residue (e.g., D, or modified form thereof) or a small amino acid residue (e.g., S or T, or modified form thereof) at position 178, $C_7$ or modified form thereof at position 179, a small amino acid residue (e.g., T, or modified form thereof) or a neutral/polar amino acid residue (e.g., N, or modified form thereof) at position 180, T or modified form thereof at position 181, G or modified form thereof at position 182, $C_8$ or modified form thereof at position 183, L or modified form thereof at position 184, K or modified form thereof at position 185, G or modified form thereof at position 186, L or modified form thereof at position 187, A or modified form thereof at position 188, N or modified form thereof at position 189, V or modified form thereof at position 190, a basic amino acid residues (e.g., H or K, or modified form thereof) or neutral/polar amino acid residue (e.g., Q, or modified form thereof) at position 191, $C_9$ or modified form thereof at position 192, S or modified form thereof at position 193, an acidic amino acid residue (e.g., D or E, or modified form thereof) or a small amino acid residue (e.g., A, or modified form thereof) at position 194, L or modified form thereof at position 195, L or modified form thereof at position 196, K or modified form thereof at position 197, K or modified form thereof at position 198, W or modified form thereof at position 199, L or modified form thereof at position 200, P or modified form thereof at position 201, any amino acid residue (e.g., small amino acid residues such as G, T, S or A, or modified form thereof, or neutral/polar amino acid residues such as Q or N, or modified form thereof, or acidic amino acid residues such as D, or modified form thereof) at position 202, a basic amino acid residue (e.g., R or K, or modified form thereof) at position 203, $C_{10}$ or modified form thereof at position 204, a small amino acid residue (e.g., A, or modified form thereof) or a basic amino acid residue (e.g., K, or modified form thereof) at position 205, a small amino acid residue (e.g., S or T, or modified form thereof) at position 206, F or modified form thereof at position 207, A or modified form thereof at position 208, an acidic amino acid residue (e.g., D, or modified form thereof) or a small amino acid residue (e.g., S, or modified form thereof) at position 209, K or modified form thereof at position 210, I or modified form thereof at position 211, Q or modified form thereof at position 212, a small amino acid residue (e.g., G or S, or modified form thereof) or a basic amino acid residue (e.g., K, or modified form thereof) at position 213, a neutral/polar amino acid residue (e.g., Q, or modified form thereof) or an acidic amino acid residue (e.g., E, or modified form thereof) at position 214, an hydrophobic amino acid residues (e.g., aliphatic amino acid residues such as V, or modified form thereof) or a small amino acid residue (e.g., A, or modified form thereof) at position 215, a charged amino acid residue (e.g., acidic amino acid residues such as D, or modified form thereof, or basic amino acid residues such as H, or modified form thereof) at position 216, any amino acid residue (e.g., basic amino acid residues such as K, or modified form thereof, or neutral/polar amino acid residues such as N, or modified form thereof, or small amino acid residues such as T, or modified form thereof) at position 217, I or modified form thereof at position 218, K or modified form thereof at position 219, G or modified form thereof at position 220, a small amino acid residue (e.g., A, or modified form thereof) or an hydrophobic amino acid residue (e.g., aliphatic amino acid residues such as L or M, or modified form thereof) at position 221, a small amino acid residue (e.g., G or A, or modified form thereof) at position 222, G or modified form thereof at position 223 and D or modified form thereof at position 224, relative to the consensus numbering of FIG. 1.

A biologically active fragment of a full-length luciferase polypeptide can be a polypeptide which is, for example, 40, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200 or more amino acid residues in length. Suitably, the biologically-active fragment has no less than about 1%, 10%, 25% 50% of an activity of the full-length polypeptide from which it is derived.

The present invention contemplates both secreted and non-secreted or intracellular luciferases. Secreted luciferases will generally comprise a signal peptide, for example comprising from about residue 1 to about residues 28, relative to the consensus numbering shown in FIG. 1. They will also generally include a secretion-enhancing sequence that extends downstream of the signal peptide and upstream of about position 85, suitably upstream of about position 84, 83, 82, 81, 80, 79, 78, 77, 76, 75, 74, 73, 72, 71. Illustrative non-secreted or intracellular luciferases generally exclude a functional signal peptide and/or functional secretion-enhancing sequence.

The present invention also contemplates luciferases that are variants of wild-type or naturally-occurring luciferases or their fragments or synthetic or artificially created luciferases or their fragments, which variants include one or more of the luminescence-enhancing modification defined herein. Such "variant" polypeptides include proteins derived from the native protein by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Non-limiting examples of such variant luciferases include processed forms of a full-length or precursor luciferase, including but not limited to polypeptides in which the signal peptide domain (from about residue 1 to about residue 17 or 18, relative to the consensus numbering shown in FIG. 1) has been removed from the precursor form.

Variant proteins encompassed by the present invention are biologically active, that is, they continue to possess the desired biological activity of the native protein. Such variants may result from, for example, genetic polymorphism or from human manipulation.

A luciferase polypeptide may be altered in various ways including amino acid substitutions, deletions, truncations, and insertions. Methods for such manipulations are generally known in the art. For example, amino acid sequence variants of luciferase polypeptides can be prepared by mutations in the DNA. Methods for mutagenesis and nucleotide sequence alterations are well known in the art. See, for example, Kunkel (1985, *Proc. Natl. Acad. Sci. USA.* 82: 488-492), Kunkel et al., (1987, *Methods in Enzymol,* 154: 367-382), U.S. Pat. No. 4,873,192, Watson, J. D. et al., ("Molecular Biology of the Gene", Fourth Edition, Benjamin/Cummings, Menlo Park, Calif., 1987) and the references cited therein. Guidance as to appropriate amino acid substitutions that do not affect biological activity of the protein of interest may be found in the model of Dayhoff et al., (1978) Atlas of Protein Sequence and Structure (Natl. Biomed. Res. Found., Washington, D.C.). Methods for screening gene products of combinatorial libraries made by point mutations or truncation, and for screening cDNA libraries for gene products having a selected property are known in the art. Such methods are adaptable for rapid screening of the gene libraries generated by combinatorial mutagenesis of luciferase polypeptides. Recursive ensemble mutagenesis (REM), a technique that enhances the frequency of functional mutants in the libraries, can be used in combination with the screening assays to identify luciferase variants (Arkin and Yourvan (1992) *Proc. Natl. Acad. Sci. USA* 89: 7811-7815; Delgrave et al., (1993) *Protein Engineering,* 6: 327-331). Conservative substitutions, such as exchanging one amino acid with another having similar properties, may be desirable as discussed in more detail below.

Variant luciferase polypeptides may contain conservative amino acid substitutions at various locations along their sequence, as compared to a parent (e.g., naturally-occurring or reference) luciferase amino acid sequence. A "conservative amino acid substitution" is one in which the amino acid residue is replaced with an amino acid residue having a similar side chain. Families of amino acid residues having similar side chains have been defined in the art, which can be generally sub-classified as follows:

Acidic: The residue has a negative charge due to loss of H ion at physiological pH and the residue is attracted by aqueous solution so as to seek the surface positions in the conformation of a peptide in which it is contained when the peptide is in aqueous medium at physiological pH. Amino acids having an acidic side chain include glutamic acid and aspartic acid.

Basic: The residue has a positive charge due to association with H ion at physiological pH or within one or two pH units thereof (e.g., histidine) and the residue is attracted by aqueous solution so as to seek the surface positions in the conformation of a peptide in which it is contained when the peptide is in aqueous medium at physiological pH. Amino acids having a basic side chain include arginine, lysine and histidine.

Charged: The residues are charged at physiological pH and, therefore, include amino acids having acidic or basic side chains (i.e., glutamic acid, aspartic acid, arginine, lysine and histidine).

Hydrophobic: The residues are not charged at physiological pH and the residue is repelled by aqueous solution so as to seek the inner positions in the conformation of a peptide in which it is contained when the peptide is in aqueous medium. Amino acids having a hydrophobic side chain include tyrosine, valine, isoleucine, leucine, methionine, phenylalanine and tryptophan.

Neutral/polar: The residues are not charged at physiological pH, but the residue is not sufficiently repelled by aqueous solutions so that it would seek inner positions in the conformation of a peptide in which it is contained when the peptide is in aqueous medium. Amino acids having a neutral/polar side chain include asparagine, glutamine, cysteine, histidine, serine and threonine.

This description also characterizes certain amino acids as "small" since their side chains are not sufficiently large, even if polar groups are lacking, to confer hydrophobicity. With the exception of proline, "small" amino acids are those with four carbons or less when at least one polar group is on the side chain and three carbons or less when not. Amino acids having a small side chain include glycine, serine, alanine and threonine. The gene-encoded secondary amino acid proline is a special case due to its known effects on the secondary conformation of peptide chains. The structure of proline differs from all the other naturally-occurring amino acids in that its side chain is bonded to the nitrogen of the α-amino group, as well as the α-carbon. Several amino acid similarity matrices (e.g., PAM120 matrix and PAM250 matrix as disclosed for example by Dayhoff et al., (1978), A model of evolutionary change in proteins. Matrices for determining distance relationships In M. O. Dayhoff, (ed.), Atlas of protein sequence and structure, Vol. 5, pp. 345-358, National Biomedical Research Foundation, Washington D.C.; and by Gonnet et al., (1992, *Science,* 256(5062): 14430-1445), however, include proline in the same group as glycine, serine, alanine and threonine. Accordingly, for the purposes of the present invention, proline is classified as a "small" amino acid.

The degree of attraction or repulsion required for classification as polar or non-polar is arbitrary and, therefore, amino acids specifically contemplated by the invention have been classified as one or the other. Most amino acids not specifically named can be classified on the basis of known behavior.

Amino acid residues can be further sub-classified as cyclic or non-cyclic, and aromatic or non-aromatic, self-explanatory classifications with respect to the side-chain substituent groups of the residues, and as small or large. The residue is considered small if it contains a total of four carbon atoms or less, inclusive of the carboxyl carbon, provided an additional polar substituent is present; three or less if not. Small residues are, of course, always non-aromatic. Dependent on their structural properties, amino acid residues may fall in two or more classes. For the naturally-occurring protein amino acids, sub-classification according to this scheme is presented in Table 1.

TABLE 1

AMINO ACID SUB-CLASSIFICATION

| Sub-classes | Amino acids |
|---|---|
| Acidic | Aspartic acid, Glutamic acid |
| Basic | Noncyclic: Arginine, Lysine; Cyclic: Histidine |
| Charged | Aspartic acid, Glutamic acid, Arginine, Lysine, Histidine |
| Small | Glycine, Serine, Alanine, Threonine, Proline |
| Polar/neutral | Asparagine, Histidine, Glutamine, Cysteine, Serine, Threonine |
| Polar/large | Asparagine, Glutamine |
| Hydrophobic | Tyrosine, Valine, Isoleucine, Leucine, Methionine, Phenylalanine, Tryptophan |
| Aromatic | Tryptophan, Tyrosine, Phenylalanine |
| Residues that influence chain orientation | Glycine and Proline |

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional luciferase peptide polypeptide can readily be determined by assaying its activity. Conservative substitutions are shown in Table 2 under the heading of exemplary and preferred substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

TABLE 2

EXEMPLARY AND PREFERRED AMINO ACID SUBSTITUTIONS

| Original Residue | Exemplary Substitutions | Preferred Substitutions |
|---|---|---|
| Ala | Val, Leu, Ile | Val |
| Arg | Lys, Gln, Asn | Lys |
| Asn | Gln, His, Lys, Arg | Gln |
| Asp | Glu | Glu |
| Cys | Ser | Ser |
| Gln | Asn, His, Lys, | Asn |
| Glu | Asp, Lys | Asp |
| Gly | Pro | Pro |
| His | Asn, Gln, Lys, Arg | Arg |
| Ile | Leu, Val, Met, Ala, Phe, Norleu | Leu |
| Leu | Norleu, Ile, Val, Met, Ala, Phe | Ile |
| Lys | Arg, Gln, Asn | Arg |
| Met | Leu, Ile, Phe | Leu |
| Phe | Leu, Val, Ile, Ala | Leu |
| Pro | Gly | Gly |
| Ser | Thr | Thr |
| Thr | Ser | Ser |
| Trp | Tyr | Tyr |
| Tyr | Trp, Phe, Thr, Ser | Phe |
| Val | Ile, Leu, Met, Phe, Ala, Norleu | Leu |

Alternatively, similar amino acids for making conservative substitutions can be grouped into three categories based on the identity of the side chains. The first group includes glutamic acid, aspartic acid, arginine, lysine, histidine, which all have charged side chains; the second group includes glycine, serine, threonine, cysteine, tyrosine, glutamine, asparagine; and the third group includes leucine, isoleucine, valine, alanine, proline, phenylalanine, tryptophan, methionine, as described in Zubay, G., *Biochemistry*, third edition, Wm. C. Brown Publishers (1993).

Thus, a predicted non-essential amino acid residue in a luciferase polypeptide is typically replaced with another amino acid residue from the same side chain family. Alternatively, mutations can be introduced randomly along all or part of a luciferase gene coding sequence, such as by saturation mutagenesis, and the resultant mutants can be screened for an activity of the parent polypeptide, as described for example herein, to identify mutants which retain that activity. Following mutagenesis of the coding sequences, the encoded polypeptide can be expressed recombinantly and its activity determined. A "non-essential" amino acid residue is a residue that can be altered from the wild-type sequence of an embodiment polypeptide without abolishing or substantially altering one or more of its activities. Suitably, the alteration does not substantially alter one of these activities, for example, the activity is at least 20%, 40%, 60%, 70% or 80% of wild-type. Illustrative non-essential amino acid residues include any one or more of the amino acid residues that differ at the same position (e.g., residues $X_1$-$X_{53}$, as defined in formula VIII supra) between the known luciferase polypeptides shown in FIG. 1.

By contrast, an "essential" amino acid residue is a residue that, when altered from the wild-type sequence of a reference luciferase polypeptide, results in abolition of an activity of the parent molecule such that less than 20% of the wild-type activity is present. In some embodiments, essential amino acid residues include those that are conserved in luciferase polypeptides across different species, e.g., P at position 86, G at position 87, K at position 88, K at position 89, P at position 91, V at position 94, E at position 97, E at position 99, A at position 100, N at position 101, A at position 102, A at position 105, G at position 106, $C_1$ at position 107, R at position 109, G at position 110, $C_2$ at position 111, L at position 112, $C_3$ at position 114, L at position 115, S at position 116, I at position 118, K at position 119, $C_4$ at position 120, T at position 121, M at position 124, I at position 128, P at position 129, G at position 130, R at position 131, $C_5$ at position 132, Y at position 135, G at position 137, D at position 138, K at position 139, Q at position 143, G at position 145, I at position 146, I at position 151, V at position 152, D at position 153, P at position 155, E at position 156, I at position 157, G at position 159, F at position 160, K at position 161, P at position 165, Q at position 168, F at position 169, I at position 170, A at position 171, Q at position 172, V at position 173, $C_6$ at position 176, $C_7$ at position 179, T at position 181, G at position 182, $C_8$ at position 183, L at position 184, K at position 185, G at position 186, L at position 187, A at position 188, N at position 189, V at position 190, $C_9$ at position 192, S at position 193, L at position 195, L at position 196, K at position 197, K at position 198, W at position 199, L at position 200, P at position 201, R at position 203, $C_{10}$ at position 204, F at position 207, A at position 208, K at position 210, I at position 211, Q at position 212, I at position 218, K at position 219, G at position 220, G at position 223 and D at position 224, relative to the consensus numbering of FIG. 1.

Accordingly, the present invention also contemplates as luciferase polypeptides, variants of a reference luciferase polypeptide (e.g., naturally-occurring luciferase polypeptide sequences or their biologically-active fragments), wherein the variants are distinguished from the reference sequence by the addition, deletion, or substitution of one or more amino acid residues. In general, variants will display at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% similarity to a parent or reference luciferase polypeptide sequence as, for example, set forth in SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 136, 138, 140, 142, 144, 146, 148, 150, 152, 154, 156, 158, 160, 162, 142, 144, 146, 148, 150, 152, 154, 156, 158, 160, 162, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788, as determined by sequence alignment programs described elsewhere herein using default parameters. Desirably, variants will have at least 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% sequence identity to a parent luciferase polypeptide sequence as, for example, set forth in SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 136, 138, 140, 142, 144, 146, 148, 150, 152, 154, 156, 158, 160, 162, 142, 144, 146, 148, 150, 152, 154, 156, 158, 160, 162, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788, as determined by sequence alignment programs described elsewhere herein using default parameters. Variants of a reference luciferase polypeptide (e.g., wild-type), which fall within the scope of a variant polypeptide, may differ from the reference molecule generally by as much 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, or 11 amino acid residues or suitably by as few as 10, 9, 8, 7, 6, 5 4, 3, 2, or 1 amino acid residue(s). In some embodiments, a variant polypeptide differs from the corresponding sequences in SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 136, 138, 140, 142, 144, 146, 148, 150, 152, 154, 156, 158, 160, 162, 142, 144, 146, 148, 150, 152, 154, 156, 158, 160, 162, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788, by at least 1 but by less than or equal to 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3 or 2 amino acid residues. In other embodiments, it differs from the corresponding sequence in any one of SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 136, 138, 140, 142, 144, 146, 148, 150, 152, 154, 156, 158, 160, 162, 142, 144, 146, 148, 150, 152, 154, 156, 158, 160, 162, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310 312, 314, 316, 318, 320 322, 324, 326, 328, 330, 332, 334, 336, 338, 340, 34, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 780, 782, 784, 786 or 788, by at least one 1% but less than or equal to 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3% or 2% of the residues. If the sequence comparison requires alignment, the sequences are typically aligned for maximum similarity or identity. "Looped" out sequences from deletions or insertions, or mismatches, are generally considered differences. The differences are, suitably, differences or changes at a non-essential residue or a conservative substitution, as discussed in more detail below.

The luciferases of the present invention also encompass luciferase polypeptides comprising amino acids with modified side chains, incorporation of unnatural amino acid residues and/or their derivatives during peptide, polypeptide or protein synthesis and the use of cross-linkers and other methods that impose conformational constraints on the peptides, portions and variants of the invention. Examples of side chain modifications include modifications of amino groups such as by acylation with acetic anhydride; acylation of amino groups with succinic anhydride and tetrahydrophthalic anhydride; amidination with methylacetimidate; carbamoylation of amino groups with cyanate; pyridoxylation of lysine with pyridoxal-5-phosphate followed by reduction with $NaBH_4$; reductive alkylation by reaction with an aldehyde followed by reduction with $NaBH_4$; and trinitrobenzylation of amino groups with 2,4,6-trinitrobenzene sulfonic acid (TNBS).

The carboxyl group may be modified by carbodiimide activation via O-acylisourea formation followed by subsequent derivatization, by way of example, to a corresponding amide.

The guanidine group of arginine residues may be modified by formation of heterocyclic condensation products with reagents such as 2,3-butanedione, phenylglyoxal and glyoxal.

Sulphydryl groups may be modified by methods such as performic acid oxidation to cysteic acid; formation of mercurial derivatives using 4-chloromercuriphenylsulphonic acid, 4-chloromercuribenzoate; 2-chloromercuri-4-nitrophenol, phenylmercury chloride, and other mercurials; formation of a mixed disulphides with other thiol compounds; reaction with maleimide, maleic anhydride or other substituted maleimide; carboxymethylation with iodoacetic acid or iodoacetamide; and carbamoylation with cyanate at alkaline pH.

Tryptophan residues may be modified, for example, by alkylation of the indole ring with 2-hydroxy-5-nitrobenzyl bromide or sulphonyl halides or by oxidation with N-bromosuccinimide.

Tyrosine residues may be modified by nitration with tetranitromethane to form a 3-nitrotyrosine derivative.

The imidazole ring of a histidine residue may be modified by N-carbethoxylation with diethylpyrocarbonate or by alkylation with iodoacetic acid derivatives.

Examples of incorporating unnatural amino acids and derivatives during peptide synthesis include but are not limited to, use of 4-amino butyric acid, 6-aminohexanoic acid, 4-amino-3-hydroxy-5-phenylpentanoic acid, 4-amino-3-hydroxy-6-methylheptanoic acid, t-butylglycine, norleucine, norvaline, phenylglycine, ornithine, sarcosine, 2-thienyl alanine and/or D-isomers of amino acids. A list of unnatural amino acids contemplated by the present invention is shown in Table 3.

TABLE 3

NON-CONVENTIONAL AMINO ACIDS

| Non-Conventional Amino Acids | |
|---|---|
| α-aminobutyric acid | L-N-methylalanine |
| α-amino-α-methylbutyrate | L-N-methylarginine |

TABLE 3-continued

| NON-CONVENTIONAL AMINO ACIDS | |
|---|---|
| Non-Conventional Amino Acids | |
| aminocyclopropane-carboxylate | L-N-methylasparagine |
| aminoisobutyric acid | L-N-methylaspartic acid |
| aminonorbornyl-carboxylate | L-N-methylcysteine |
| cyclohexylalanine | L-N-methylglutamine |
| cyclopentylalanine | L-N-methylglutamic acid |
| L-N-methylisoleucine | L-N-methylhistidine |
| D-alanine | L-N-methylleucine |
| D-arginine | L-N-methyllysine |
| D-aspartic acid | L-N-methylmethionine |
| D-cystcinc | L-N-methylnorleucine |
| D-glutamate | L-N-methylnorvaline |
| D-glutamic acid | L-N-methylornithine |
| D-histidine | L-N-methylphenylalanine |
| D-isoleucine | L-N-methylproline |
| D-leucine | L-N-medlylserine |
| D-lysine | L-N-methylthreonine |
| D-methionine | L-N-methyltryptophan |
| D-ornithine | L-N-methyltyrosine |
| D-phenylalanine | L-N-methylvaline |
| D-proline | L-N-methylethylglycine |
| D-serine | L-N-methyl-t-butylglycine |
| D-threonine | L-norleucine |
| D-tryptophan | L-norvaline |
| D-tyrosine | α-methyl-aminoisobutyrate |
| D-valine | α-methyl-γ-aminobutyrate |
| D-α-methylalanine | α-methylcyclohexylalanine |
| D-α-methylarginine | α-methylcylcopentylalanine |
| D-α-methylasparagine | α-methyl-α-napthylalanine |
| D-α-methylaspartate | α-methylpenicillamine |
| D-α-methylcysteine | N-(4-aminobutyl)glycine |
| D-α-methylglutamine | N-(2-aminoethyl)glycine |
| D-α-methylhistidine | N-(3-aminopropyl)glycine |
| D-α-methylisoleucine | N-amino-α-methylbutyrate |
| D-α-methylleucine | a-napthylalanine |
| D-α-methyllysine | N-benzylglycine |
| D-α-methylmethionine | N-(2-carbamylediyl)glycine |
| D-α-methylornithiine | N-(carbamylmethyl)glycine |
| D-α-methylphenylalanine | N-(2-carboxyethyl)glycine |
| D-α-methylproline | N-(carboxymethyl)glycine |
| D-α-methylserine | N-cyclobutylglycine |
| D-α-methylthreonine | N-cycloheptylglycine |
| D-α-methyltryptophan | N-cyclohexylglycine |
| D-α-methyltyrosine | N-cyclodecylglycine |
| L-α-methylleucine | L-α-methyllysine |
| L-α-methylmethionine | L-α-methylnorleucine |
| L-α-methylnorvatine | L-α-methylornithine |
| L-α-methylphenylalanine | L-α-methylproline |
| L-α-methylserine | L-α-methylthreonine |
| L-α-methyltryptophan | L-α-methyltyrosine |
| L-α-methylvaline | L-N-methylhomophenylalanine |
| N-(N-(2,2-diphenylethyl carbamylmethyl)glycine | N-(N-(3,3-diphenylpropyl carbamylmethyl)glycine |
| 1-carboxy-1-(2,2-diphenyl-ethyl amino)cyclopropane | |

The luciferases of the present invention also include polypeptides that are encoded by polynucleotides that hybridize under stringency conditions as defined herein, especially medium or high stringency conditions, to luciferase-encoding polynucleotide sequences, or the non-coding strand thereof, as described below. Illustrative luciferase polynucleotide sequences are set forth in SEQ ID NO:11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 135, 137, 139, 141, 143, 145, 147, 149, 151, 153, 155, 157, 159, 161, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or their complements.

In some embodiments, calculations of sequence similarity or sequence identity between sequences are performed as follows:

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In some embodiments, the length of a reference sequence aligned for comparison purposes is at least 30%, usually at least 40%, more usually at least 50%, 60%, and even more usually at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide at the corresponding position in the second sequence, then the molecules are identical at that position. For amino acid sequence comparison, when a position in the first sequence is occupied by the same or similar amino acid residue (i.e., conservative substitution) at the corresponding position in the second sequence, then the molecules are similar at that position.

The percent identity between the two sequences is a function of the number of identical amino acid residues shared by the sequences at individual positions, taking into account the number of gaps, and the length of each gap, which need to be introduced for optimal alignment of the two sequences. By contrast, the percent similarity between the two sequences is a function of the number of identical and similar amino acid residues shared by the sequences at individual positions, taking into account the number of gaps, and the length of each gap, which need to be introduced for optimal alignment of the two sequences.

The comparison of sequences and determination of percent identity or percent similarity between sequences can be accomplished using a mathematical algorithm. In certain embodiments, the percent identity or similarity between amino acid sequences is determined using the Needleman and Wünsch, (1970, *J. Mol. Biol.* 48: 444-453) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. In specific embodiments, the percent identity between nucleotide sequences is determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. An non-limiting set of parameters (and the one that should be used unless otherwise specified) includes a Blossum 62 scoring matrix with a gap penalty of 12, a gap extend penalty of 4, and a frameshift gap penalty of 5.

In some embodiments, the percent identity or similarity between amino acid or nucleotide sequences can be determined using the algorithm of E. Meyers and W. Miller (1989, *Cabios,* 4: 11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al., (1990, *J. Mol. Biol,* 215: 403-10). BLAST nucleotide searches can be performed with the NBLAST program, score=100, wordlength=12 to obtain nucleotide sequences homologous to 53010 nucleic acid molecules of the invention. BLAST protein searches can be performed with the XBLAST program, score=50, wordlength=3 to obtain amino acid sequences homologous to 53010 protein molecules of the invention. To obtain gapped alignments for comparison purposes, Gapped BLAST can be utilized as described in Altschul et al., (1997, *Nucleic Acids Res,* 25: 3389-3402). When utilizing BLAST and Gapped BLAST programs, the default parameters of the respective programs (e.g., XBLAST and NBLAST) can be used.

Variants of a reference luciferase polypeptide can be identified by screening combinatorial libraries of mutants, e.g., truncation mutants, of a luciferase polypeptide. Libraries or fragments e.g., N terminal, C terminal, or internal fragments, of a luciferase coding sequence can be used to generate a variegated population of fragments for screening and subsequent selection of variants of a reference luciferase.

Methods for screening gene products of combinatorial libraries made by point mutation or truncation, and for screening cDNA libraries for gene products having a selected property are known in the art. Such methods are adaptable for rapid screening of the gene libraries generated by combinatorial mutagenesis of luciferase polypeptides.

The luciferase polypeptides of the present invention may be prepared by any suitable procedure known to those of skill in the art. For example, the luciferase polypeptides may be produced by any convenient method such as by purifying the polypeptides from luciferase-producing organisms. Methods of purification include size exclusion, affinity or ion exchange chromatography/separation. The identity and purity of derived luciferases is determined for example by SDS-polyacrylamide electrophoresis or chromatographically such as by high performance liquid chromatography (HPLC). Alternatively, the luciferases polypeptides may be synthesized by chemical synthesis, e.g., using solution synthesis or solid phase synthesis as described, for example, in Chapter 9 of Atherton and Shephard (supra) and in Roberge et al., (1995, *Science,* 269: 202).

In some embodiments, the luciferase polypeptides are prepared by recombinant techniques. For example, the luciferase polypeptides of the invention may be prepared by a procedure including the steps of: (a) preparing a construct comprising a polynucleotide sequence that encodes a luciferase polypeptide and that is operably linked to a regulatory element; (b) introducing the construct into a host cell; (c) culturing the host cell to express the polynucleotide sequence to thereby produce the encoded luciferase polypeptide; and (d) isolating the luciferase polypeptide from the host cell. In illustrative examples, the nucleotide sequence encodes at least a biologically active portion of the sequences set forth in SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 135, 137, 139, 141, 143, 145, 147, 149, 151, 153, 155, 157, 159, 161, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or a variant thereof. Recombinant luciferase polypeptides can be conveniently prepared using standard protocols as described for example in Sambrook, et al., (1989, supra), in particular Sections 16 and 17; Ausubel et al., (1994, supra), in particular Chapters 10 and 16; and Coligan et al., Current Protocols in Protein Science (John Wiley & Sons, Inc. 1995-1997), in particular Chapters 1, 5 and 6.

Exemplary nucleotide sequences that encode the luciferase polypeptides of the invention encompass full-length luciferase genes as well as portions of the full-length or substantially full-length nucleotide sequences of the luciferase genes or their transcripts or DNA copies of these transcripts. Portions of a luciferase nucleotide sequence may encode polypeptide portions or segments that retain the biological activity of the native polypeptide. A portion of a luciferase nucleotide sequence that encodes a biologically active fragment of a luciferase polypeptide may encode at least about 40, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200 or more contiguous amino acid residues, or almost up to the total number of amino acids present in a full-length luciferase polypeptide.

The invention also contemplates variants of the luciferase nucleotide sequences. Nucleic acid variants can be naturally-occurring, such as allelic variants (same locus), homologs (different locus), and orthologs (different organism) or can be non naturally-occurring. Naturally-occurring nucleic acid variants (also referred to herein as polynucleotide variants) such as these can be identified with the use of well-known molecular biology techniques, as, for example, with polymerase chain reaction (PCR) and hybridization techniques as known in the art. Non-naturally occurring polynucleotide variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product). For nucleotide sequences, conservative variants include those sequences that, because of the degeneracy of the genetic code, encode the amino acid sequence of a reference luciferase polypeptide. Variant nucleotide sequences also include synthetically derived nucleotide sequences, such as those generated, for example, by using site-directed mutagenesis but which still encode a luciferase polypeptide. Generally, variants of a particular luciferase nucleotide sequence will have at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to that particular nucleotide sequence as determined by sequence alignment programs described elsewhere herein using default parameters. In some embodiments, the luciferase nucleotide sequence displays at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a nucleotide sequence selected from any one of SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 135, 137, 139, 141, 143, 145, 147, 149, 151, 153, 155, 157, 159, 161, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or their complements.

Luciferase nucleotide sequences can be used to isolate corresponding sequences and alleles from other organisms, particularly other copepods. Methods are readily available in the art for the hybridization of nucleic acid sequences. Coding sequences from other organisms may be isolated according to well-known techniques based on their sequence identity with the coding sequences set forth herein. In these techniques all or part of the known coding sequence is used as a probe that selectively hybridizes to other luciferase-coding sequences present in a population of cloned genomic DNA fragments or cDNA fragments (i.e., genomic or cDNA libraries) from a chosen organism (e.g., a copepod). Accordingly, the present invention also contemplates polynucleotides that hybridize to reference luciferase nucleotide sequences, or to their complements, (e.g., SEQ ID NO: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 135, 137, 139, 141, 143, 145, 147, 149, 151, 153, 155, 157, 159, 161, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 781, 783, 785 or 787, or their complements) under stringency conditions described below. As used herein, the term "hybridizes under low stringency, medium stringency, high stringency, or very high stringency conditions" describes conditions for hybridization and washing. Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M $NaHPO_4$ (pH 7.2), 7% SDS for hybridization at 65° C., and (i) 2×SSC, 0.1% SDS; or (ii) 0.5% BSA, 1 mM EDTA, 40 mM $NaHPO_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M $NaHPO_4$ (pH 7.2), 7% SDS for hybridization at 65° C., and (i) 2×SSC, 0.1% SDS; or (ii) 0.5% BSA, 1 mM EDTA, 40 mM $NaHPO_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5 M $NaHPO_4$ (pH 7.2), 7% SDS for hybridization at 65° C., and (i) 0.2×SSC, 0.1% SDS; or (ii) 0.5% BSA, 1 mM EDTA, 40 mM $NaHPO_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C.

In certain embodiments, a luciferase polypeptide is encoded by a polynucleotide that hybridizes to a disclosed nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C.

Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

While stringent washes are typically carried out at temperatures from about 42° C. to 68° C., one skilled in the art will appreciate that other temperatures may be suitable for stringent conditions. Maximum hybridization rate typically occurs at about 20° C. to 25° C. below the $T_m$ for formation of a DNA-DNA hybrid. It is well known in the art that the $T_m$ is the melting temperature, or temperature at which two complementary polynucleotide sequences dissociate. Methods for estimating $T_m$ are well known in the art (see Ausubel et al., supra at page 2.10.8). In general, the $T_m$ of a perfectly matched duplex of DNA may be predicted as an approximation by the formula:

$$T_m=81.5+16.6(\log_{10} M)+0.41(\%G+C)-0.63(\%\text{formamide})-(600/\text{length})$$

wherein: M is the concentration of $Na^+$, preferably in the range of 0.01 molar to 0.4 molar; % G+C is the sum of guanosine and cytosine bases as a percentage of the total number of bases, within the range between 30% and 75% G+C; % formamide is the percent formamide concentration by volume; length is the number of base pairs in the DNA duplex. The $T_m$ of a duplex DNA decreases by approximately 1° C. with every increase of 1% in the number of randomly mismatched base pairs. Washing is generally carried out at $T_m$−15° C. for high stringency, or $T_m$−30° C. for moderate stringency.

In one example of a hybridization procedure, a membrane (e.g., a nitrocellulose membrane or a nylon membrane) containing immobilized DNA is hybridized overnight at 42° C. in a hybridization buffer (50% deionized formamide, 5×SSC, 5×Denhardt's solution (0.1% ficoll, 0.1% polyvinylpyrrolidone and 0.1% bovine serum albumin), 0.1% SDS and 200 mg/mL denatured salmon sperm DNA) containing labeled probe. The membrane is then subjected to two sequential medium stringency washes (i.e., 2×SSC, 0.1% SDS for 15 min at 45° C., followed by 2×SSC, 0.1% SDS for 15 min at 50° C.), followed by two sequential higher stringency washes (i.e., 0.2×SSC, 0.1% SDS for 12 min at 55° C. followed by 0.2×SSC and 0.1% SDS solution for 12 min at 65-68° C.

4. Chimeric Constructs

The invention further contemplates chimeric constructs comprising a nucleic acid sequence encoding a luciferase of the invention, which is operably linked to a regulatory sequence. The regulatory sequence suitably comprises transcriptional and/or translational control sequences, which will be compatible for expression in the organism of interest or in cells of that organism. Typically, the transcriptional and translational regulatory control sequences include, but are not limited to, a promoter sequence, a 5' non-coding region, a cis-regulatory region such as a functional binding site for transcriptional regulatory protein or translational regulatory protein, an upstream open reading frame, ribosomal-binding sequences, transcriptional start site, translational start site, and/or nucleotide sequence which encodes a leader sequence, termination codon, translational stop site and a 3' non-translated region. Constitutive or inducible promoters as known in the art are contemplated by the invention. The promoters may be either naturally occurring promoters, or hybrid promoters that combine elements of more than one promoter. Promoter sequences contemplated by the present invention may be native to the organism of interest or may be derived from an alternative source, where the region is functional in the chosen organism. The choice of promoter will differ depending on the intended host or cell or tissue type. For example, promoters which could be used for expression in mammals include the metallothionein promoter, which can be induced in response to heavy metals such as cadmium, the β-actin promoter as well as viral promoters such as the SV40 large T antigen promoter, human cytomegalovirus (CMV) immediate early (IE) promoter, Rous sarcoma virus LTR promoter, the mouse mammary tumor virus LTR promoter, the adenovirus major late promoter (Ad MLP), the herpes simplex virus promoter, and a HPV promoter, particularly the HPV upstream regulatory region (URR), among others. All these promoters are well described and readily available in the art.

Enhancer elements may also be used herein to increase expression levels of the mammalian constructs. Examples include the SV40 early gene enhancer, as described for example in Dijkema et al. (1985, EMBO J. 4:761), the enhancer/promoter derived from the long terminal repeat (LTR) of the Rous Sarcoma Virus, as described for example in Gorman et al., (1982, Proc. Natl. Acad. Sci. USA 79:6777) and elements derived from human CMV, as described for example in Boshart et al. (1985, Cell 41:521), such as elements included in the CMV intron A sequence.

The chimeric construct may also comprise a 3' non-translated sequence. A 3' non-translated sequence refers to that portion of a gene comprising a DNA segment that contains a polyadenylation signal and any other regulatory signals capable of effecting mRNA processing or gene expression. The polyadenylation signal is characterized by effecting the addition of polyadenylic acid tracts to the 3' end of the mRNA precursor. Polyadenylation signals are commonly recognized by the presence of homology to the canonical form 5' AATAAA-3' although variations are not uncommon. The 3' non-translated regulatory DNA sequence preferably includes from about 50 to 1,000 nts and may contain transcriptional and translational termination sequences in addition to a polyadenylation signal and any other regulatory signals capable of effecting mRNA processing or gene expression.

In some embodiments, the chimeric construct further contains a selectable marker gene to permit selection of cells containing the construct. Selection genes are well known in the art and will be compatible for expression in the cell of interest.

It will be understood, however, that expression of protein-encoding polynucleotides in heterologous systems is now well known, and the present invention is not directed to or dependent on any particular vector, transcriptional control sequence or technique for expression of the polynucleotides. Rather, chimeric constructs prepared according to the methods set forth herein may be introduced into a host cell or animal in any suitable manner in the form of any suitable construct or vector, and the luciferase coding sequence may be expressed with known transcription regulatory elements in any conventional manner.

The luciferase-encoding portion of the chimeric construct may comprise a naturally-occurring sequence or a variant thereof, which has been engineered using recombinant techniques. In one example of a variant, the codon composition of luciferase coding sequence is modified to permit enhanced expression of the luciferase in a host cell or tissue of choice using standard method known in the art. For example, the luciferase coding sequence may be modified to introduce codons that are employed more frequently in one organism relative to another organism, e.g., a distantly related organism. Alternatively or in addition, the coding sequence may be modified to add or modify Kozak sequences and/or introns, and/or to remove undesirable sequences, for instance, potential transcription factor binding sites. Such optimized sequences can produce enhanced expression, e.g., increased levels of protein expression, when introduced into a host cell. Non-limiting host cells for the practice of the present invention include prokaryotic cells (e.g., bacteria) and eukaryotic cells (e.g., plant, yeast, worm, insect or mammalian cells). In specific embodiments, the host cells are mammalian cells, particularly primate, human and can be associated with any animal of interest, including but not limited to domestic animals, such as equine, bovine, murine, ovine, canine, feline, etc. Among these species, various types or cells can be used, such as hematopoietic, neural, mesenchymal, cutaneous, mucosal, stromal, muscle spleen, reticuloendothelial, epithelial, endothelial, hepatic, kidney, gastrointestinal, pulmonary etc. Also, in another embodiment, the cells are stem cells and progenitors, such as hematopoietic neural, stromal, muscle, hepatic, pulmonary, gastrointestinal, etc.

5. Fusion Proteins

The present invention also contemplates fusion proteins of the subject modified luciferase polypeptides, or fragments thereof, which are fused to a heterologous proteinaceous moiety, non-limiting examples of which include a degradation sequence (e.g., a destabilizing amino acid at the amino-terminus of the luciferase polypeptide, a PEST sequence or ubiquitin or biologically active fragments thereof, for decreasing the half-life of the modified luciferase polypeptides, especially for use as transcription reporters for drug discovery), a signal peptide (e.g., one that secretes the luciferase polypeptide or fragment thereof to an extracellular location, etc), an intracellular localization signal such as a nuclear localization signal, a membrane localization signal, a cytoplasmic localization signal, a mitochondrial localization signal, an endoplasmic reticulum (ER) localization signal or a transmembrane localization signal.

Fusion proteins may comprise a subject luciferase, or fragment thereof, and a heterologous or non-luciferase polypeptide (e.g., a "fusion partner") fused in-frame at the N-terminus and/or C-terminus of a modified luciferase polypeptide of the present invention. Fusion partners include, but are not limited to, polypeptides that can bind antibody specific to the fusion partner (e.g., epitope tags); antibodies or binding fragments thereof; polypeptides that provide a catalytic function or induce a cellular response; ligands or receptors or mimetics thereof; and the like. In such fusion proteins, the fusion partner is generally not naturally associated with the modified luciferase polypeptide of the fusion protein, and is typically not copepod protein or derivative/fragment thereof, i.e., it is not found in *Copepoda* species.

In other embodiments, the heterologous moiety is a selectable marker protein, illustrative examples of which include selectable marker proteins such as but not limited to kanamycin kinase, neomycin phosphotransferase, aminoglycoside phosphotransferase, puromycin N-acetyl transferase, puromycin resistance protein or biologically active fragments thereof. Chimeric genes of this type can be constructed using standard recombinant or synthetic techniques, as described for example in U.S. Patent Application Publication No. 2002/0150912 and in European Patent Application No. 1 262 553.

The modified luciferases of the present invention may also be fused to heterologous moieties that are photoproteins for BRET applications. Non-limiting examples of such photoproteins include but not limited to aequorin, clytin, obelin, berovin or bolinopsin photoproteins.

6. Applications

The modified luciferases described herein find use in a wide variety of procedures and applications. For example, they may be used in the methods for labeling, analyzing or detecting a biological molecule, cell or cell organelle.

In some embodiments, the subject luciferases find use as in vivo labels (or reporter molecules) in cell and molecular biology assays, including in bacterial and eukaryotic systems, especially in mammalian cells, in bacteria, in yeasts and in plants. In illustrative examples, the modified luciferases are useful in single or multi (e.g., dual) reporter systems for "high content screening" (HCS), for cellular systems, especially for receptors (e.g., detection of receptor dimers, heterodimers and homodimers, including but not limited to detection of G protein coupled receptors (GPCRs)), for ion (e.g., $Ca^{2+}$, $Na^{+}$, $K^{+}$) channels, for transporters, for transcription factors, for inducible systems, for proteinases, for kinases, for phosphodiesterases, for hydrolases, for peptidases, for transferases, for membrane proteins or for glycoproteins.

The modified luciferases of the present invention are also useful as reporter molecules for cellular systems in combination with bioluminescent or chemiluminescent systems, especially systems with oxygenases, or with phosphatases or with photoproteins and ion indicators, especially aequorin, clytin, obelin, berovin and bolinopsin.

They are also useful as marker proteins, including for flow cytometric analysis.

In other embodiments, the modified luciferases described herein are suitable for immobilization, especially by antibodies, by biotin, by magnetic or magnetizable supports.

The modified luciferases of the present invention also find use as markers, including coupled to antibodies, coupled to enzymes, coupled to receptors, coupled to ion channels and other proteins, or used as markers via a coupling mediator, including via biotin, via NHS(N-hydroxysulfosuccinimide) or via CN—Br.

They also find utility in energy transfer systems, especially the FRET (fluorescence resonance energy transfer), BRET (bioluminescence resonance energy transfer), FET (field effect transistors), FP (fluorescence polarization), HTRF (homogeneous time-resolved fluorescence) systems.

The luciferases of the present invention are also useful in protein complementation assays (as disclosed, for example, in Remy & Michnick, 2006, *Nature Methods,* 3(12):977-979 and Kim et al., 2009, *Anal Chem.,* 81: 67-74) and for analyzing interactions, including protein-protein interactions, DNA-protein interactions, DNA-RNA interactions, RNA-RNA interactions and RNA-protein interactions (DNA:deoxyribonucleic acid; RNA:ribonucleic acid).

In other embodiments, they are useful as markers or fusion proteins for expression in transgenic organisms, especially in mice, in rats, in hamsters and other mammals, in primates, in fish, in worms, in plants.

Additionally, they find utility in bacterial systems, especially for determining titers, as substrates for biochemical systems, especially for proteinases and kinases, in microarrays, in in vivo and ex vivo bioluminescence imaging, tumor research, imaging (e.g., in vitro, in vivo and ex vivo as well as whole animal imaging), infectious disease monitoring, gene delivery monitoring, gene therapy monitoring, biosensors for pollutants and biological disease markers, immunoassays (e.g., immunohistochemistry, Western blot, ELISA and in situ hybridization), drug testing, drug development and bioprocessing (as disclosed, for example, in Roda et al., 2004, *Trends in Biotechnology,* 22(6): 295-303).

The modified luciferases are also useful in any application based on the monitoring of ATP levels either directly or through coupled enzyme reactions, such as microbiological tests; assays of enzymes, substrates and cofactors; monitoring of bacterial contamination of food; DNA probes assays; receptor:ligand (e.g., ion, $2^{nd}$ messenger and protein) interactions; protein blotting and photographic assays (see, for example, L. J. Kricka, 1988, *Anal. Biochem.,* 175:14-21).

They are also useful in any industrial/domestic/recreational/military bioluminescent lighting/illumination application based on the emission of light for devices that provide illumination without heat, spark or flame (for example, Cyalume technology).

The present invention is also useful in any application in which light emission is used to create a novelty item, e.g., articles of manufacture designed for entertainment, recreation and amusement, including toys, personal items, such as cosmetics, bath powders, body lotions, gels, powders and creams, toothpastes and other dentifrices, soaps, body paints, and bubble bath, fountains, including liquid "fireworks" and other such jets or sprays or aerosols of compositions that are solutions, mixtures, suspensions, powders, pastes, particles or other formulations, as described for example in U.S. Pat. Nos. 6,113,886, 6,232,107 and 6,436,682.

The present invention is also useful in any materials that could be used in tagging applications or anti-tampering applications.

7. Kits

The present invention further provides kits for the foregoing applications. The kits can be multifunctional so they are useful for more than one purpose or application. Kits typically include the luciferase polypeptides of the invention as such, or a nucleic acid encoding the same suitably with elements for expressing the subject polypeptides, for example, a construct such as a vector comprising a nucleic acid encoding a luciferase polypeptide as defined herein.

In some embodiments, the kits comprise lyophilized modified luciferase in one container, while another container contains reconstitution buffer and optionally one or more ATPase inhibitors (e.g., TCA, DMSA, CTAB, ethanol, and the like). The kits may also supply a luciferase substrate, such as luciferin, coelenterazine, or analogs or functional derivatives thereof. The kit may also supply magnesium or other cations such as manganese or calcium. To facilitate the use of control experiments with known concentrations of ATP, such as in embodiments of the kits that are used to quantify ATP in a sample, a container that has ATP may also be supplied in such kits. The kit may also supply one or more of: a compound that prevents an increase in the amount of ATP in the sample over time (e.g., NaF); an ATPase inhibitor, a buffer or bivalent cations ($Mg^{2+}$; $Mn^{2+}$).

Alternatively, or in addition, the kits may comprise any one or more of a stabilizer, a chelating or sequestering agent, a reducing agent or a cell-lysing agent (e.g., detergents). Non-limiting examples of stabilizers include serum albumins, lactalbumins, ovalbumins, gelatins or THESIT. Illustrative chelating agents are selected from ethylenediaminetetraacetic acid (EDTA), ethylene glycol-bis(2-aminoethylether)-tetraacetic acid (EGTA) or cyclohexane-1,2-diaminetetraacetic acid (CDTA). Suitable reducing agents include but are not limited to thiol-containing compounds, such as DTT CoA, or non-thiol reducing agents such as thiosulfate, sulfite, or dithionite.

In some embodiments, the kits comprise a nucleic acid construct or vector for conducting reporter assays, wherein the construct or vector comprises a nucleotide sequence encoding a luciferase polypeptide of the present invention. In certain embodiments, the kits comprise a plurality of different vectors each encoding a modified luciferase as defined herein, where the vectors are designed for expression in different environments and/or under different conditions, for example, constitutive expression where the vector includes a strong promoter for expression in mammalian cells or a promoterless vector with a multiple cloning site for custom insertion of a promoter and tailored expression, etc.

Also present in the kits may be antibodies specific to the provided luciferase polypeptide.

The different components of the kit may be packaged in separate containers and admixed prior to use. The different components may comprise subsets of these parts and may be combined in any way that either facilitates the application of the invention or prolongs storage life. In most instances the kits contain an instruction booklet for using a modified luciferase of the present invention in any suitable application, as described for example above.

In order that the invention may be readily understood and put into practical effect, particular preferred embodiments will now be described by way of the following non-limiting examples.

EXAMPLES

Example 1

Part I: Known Luciferases of the Family

FIG. 1 shows an alignment of the amino acid sequences corresponding to known copepod luciferases, including wild-type and mutant sequences. All of full-length wild-type luciferases are secreted in their native form and the end of their signal peptides is immediately upstream of the secretion-enhancing sequence highlighted in grey. The conserved cysteines $C_1$ to $C_{10}$ are highlighted in yellow. These indicated cysteines all form disulfide bonds in the folded protein and are important for luciferase activity. A conserved PGKK motif is underlined.

The inventors noted a high degree of homology between these family members from the conserved PGKK motif onwards. Therefore they aligned this section of the polypeptides (and the signal peptides) using the BLOSUM algorithm within the ClustalW2 program. The region between the signal peptide and the conserved PGKK motif (henceforth named the "leader peptide") displayed considerable divergence amongst the family members and was aligned manually in FIG. 1.

FIG. 1 also shows the amino acid sequences of the known mutant luciferases of the family. Of these, only 3 are [non-secreted/intracellular]. One of these is the endoplasmic reticulum-retained Gaussia luciferase, described by Prolume, which comprises the C-terminal ER-retention signal KDEL. The other two are the intracellular *Gaussia* luciferase (GSInGa) and intracellular *Metridia longa* (ML164) luciferases described in WO/2008/049160, which lack a signal peptide and also comprise a PEST sequence (not indicated in Figure) fused to their C-termini.

The amino acid sequences (from PGKK onwards) were compared and the results are shown as an amino acid identity table (TABLE 4). These data reveal that the family is comprised of two sub-families. Sub-family 1 includes ML45, ML39, ML7, ML16, ML52, ML164, MLAL and MP1. Sub-family 2 includes ML22, MP2a, MP2b and Ga.

encoded polypeptides of these constructs, as well as the restriction enzyme (RE) sites engineered for their subsequent manipulation.

To ensure that any differences in activity related to enzymatic activity rather than simply protein or mRNA half-lives, the inventors used GeneStream's pRR-29.3 plasmids, which comprise a potent RNA destabilizing element and fuse to the C-terminus of the luciferase proteins a potent PEST domain for protein destabilization. Expression was driven by an EF1-alpha promoter.

The resultant plasmids were transiently transfected into HeLa cells. The previously described GSInGa luciferase (e.g., as disclosed in WO 2008/049160) was included as a comparison. As a transfection control, the inventors co-transfected an EF1-alpha driven synthetic orange luciferase (SOL) luciferase that utilizes luciferin as a substrate. Cells were lysed at 24 hrs after transfection and aliquots were transferred to a 96-well plate and assayed at room temperature using a dual-luciferase assay kit (e.g., as disclosed in WO 2002/072844). Flash luminescence was measured using a Victor Light luminometer (Perkin Elmer) and the data was normalised data for SOL activity.

TABLE 5 shows the relative activity of intracellular ML45 (iML45), ML39 (iML39), MP1v1 (iMP1v1), MP2a (iMP2a), ML22 (iML22) and GSInGa luciferases. Surprisingly, the data showed very low activity for all of the novel intracellular luciferase mutants compared to the known GSInGa luciferase, indicating that simple removal of the signal peptide is not sufficient to create intracellular mutants of non-Gaussia members of this family of luciferases with adequate performance levels.

TABLE 4

| | PGKK -> stop | | | | | | | | | | |
|---|---|---|---|---|---|---|---|---|---|---|---|
| | Ga | ML22 | MP2a | MP2b | MP1 | ML39 | ML45 | ML164 | MLAL | ML16 | ML52 |
| Ga | 100 | | | | | | | | | | |
| ML22 | 80.58 | 100 | | | | | | | | | |
| MP2a | 84.78 | 87.86 | 100 | | | | | | | | |
| MP2b | 85.51 | 88.57 | 99.28 | 100 | | | | | | | |
| MP1 | 80.43 | 77.14 | 76.26 | 75.54 | 100 | | | | | | |
| ML39 | 76.81 | 75.71 | 73.38 | 73.38 | 93.53 | 100 | | | | | |
| ML45 | 76.09 | 73.57 | 71.22 | 71.22 | 91.37 | 93.53 | 100 | | | | |
| ML164 | 75.36 | 73.57 | 70.5 | 70.5 | 91.37 | 93.56 | 99.28 | 100 | | | |
| MLAL | 76.09 | 74.29 | 71.22 | 71.22 | 91.3 | 92.09 | 97.12 | 97.84 | 100 | | |
| ML16 | 75.36 | 73.57 | 70.5 | 70.5 | 90.65 | 94.24 | 98.56 | 99.28 | 97.12 | 100 | |
| ML52 | 75.36 | 72.86 | 70.5 | 70.5 | 90.65 | 92.81 | 99.28 | 98.56 | 96.4 | 97.84 | 100 |
| | | | | | | | identity | >90% | >85% | >80% | >75% |

For experimental analysis, 3 members of sub-family 1 (ML45, ML39 and MP1) and 2 members of sub-family 2 (MP2a and ML22) were initially selected.

Example 2

Part II: Intracellular Expression of the Luciferases

Although the secreted forms of these luciferases are reported to provide higher sensitivity than firefly or *Renilla* luciferases, secreted luciferases accumulate in the culture medium and therefore are not ideal for reporter studies aimed at measuring temporal changes in gene expression. Therefore, the present inventors sought to quantify and compare their performance as intracellular luciferases. To this end, they constructed expression plasmids comprising a humanized coding sequence for each of the 5 selected luciferases, in which the signal peptides were deleted. The

TABLE 5

| | DLA |
|---|---|
| GSInGa | 1264.1 |
| iMP1v1 | 66.0 |
| iMP2a | 40.1 |
| iML22 | 11.6 |
| iML39 | 30.6 |
| iML45 | 44.9 |

Example 3

Part III: Optimizing the N-Terminal (Leader) Sequence of the Novel Intracellular Luciferases Analysis of the wild type luciferases shown in FIG. 1 revealed that the most highly variable region within the family lies downstream of the signal peptide and upstream of the conserved PGKK sequence located at our engineered XmaI site. This region was designated the "leader sequence" (also referred to herein as the "secretion-enhancer sequence") and it was speculated that this region may contribute to the varied performance of different members of the family. As such, the inventors tested the performance effects of substituting in a variety of different synthetic leader sequences via the NcoI and XmaI sites. Using progressively shorter leader sequences, the inventors surprisingly found that a large portion of this leader sequence was non-essential for intracellular localization of an active luciferase.

For example, the inventors created plasmids encoding truncated mutants of each of the 5 test luciferases, in which the wild-type leader sequence was replaced by a very short synthetic leader sequence, which was designated "DAD" (MGSDADRGKM; where the first M is the start codon and the second M is immediately upstream of the conserved PGKK motif). These plasmids and their full-length (FL) counterparts were transiently transfected into HeLa cells and luciferase activity quantified as described in Example 2/TABLE 5. The data are presented in TABLE 6A.

TABLE 6A

| DLA | iMP1v1 | iML45 | iML22 | iMP2a | iML39 | Ga |
|---|---|---|---|---|---|---|
| DAD | 31.73 | 64.02 | 12.30 | 22.10 | 14.44 | |
| FL | 18.08 | 10.03 | 1.72 | 9.56 | 7.18 | 519.64 |

The results presented in TABLE 6A show that substituting the DAD leader for the wild-type leader sequence improved the signal strength of all 5 luciferases.

Next, the inventors tested the effect of temperature on these luciferases as follows: Twenty μL aliquots of the lysates were transferred to a 96-well plate and manually mixed with 60 μL of Flash & Glow assay buffer (F&G) (Gene Stream Pty Ltd, Australia) to initiate a glow reaction. Ten minutes later, luminescence was measured at room temperature (RT). The plate was then transferred to a refrigerator set to 8° C. and left for 15 min to cool before being quickly transferred back to the luminometer for a second measurement. A duplicate plate was assayed simultaneously and kept at room temperature for luminescence signal normalization. Data were expressed as the percentage change in luminescence; i.e., (8° C. plate-RT plate)/RT plate; and are shown in TABLE 6B.

TABLE 6B

| 8° C. | iMP1v1 | iML45 | iML22 | iMP2a | iML39 |
|---|---|---|---|---|---|
| DAD | 645% | 246% | 656% | 868% | 999% |
| FL | 670% | 370% | 986% | 973% | 1239% |

TABLE 6B shows that all 5 full-length luciferases generate a much stronger luminescent signal at the cooler temperature. Surprisingly, the truncated leader sequence reduced the magnitude of this change in all cases.

Next, the present inventors investigated the importance of the amino acids within the DAD leader peptide. To determine which, if any, of these amino acids is/are essential, they constructed and tested (as per Example 3/TABLE 6) numerous mutant variants of the DAD leader peptide, in the context of iMP1v1, in which one or more of the amino acids within the (M)GSDADRGKM peptide was substituted or deleted. One such mutant was (M)NSDADRGKM, which represents the native peptide present in that region of MP1v1. Thus, this construct represents a simple truncation, without any amino acid substitutions. It was designated MP1-d. Another mutant tested was (M)NSDADRGKL, which differs from the corresponding native sequence iniMP1v1 only via the substitution of a L for the final M. It was designated MP1-dL TABLE 7A shows the performance of these mutants. Relative to full-length MP1 (MP1-FL), the deletion mutant (MP1-d) shows enhanced signal in the dual luciferase assay (DLA) and a reduced effect of the temperature change. Surprisingly, MP1-dL showed a very substantial improvement in both parameters, not only relative to the full length control but also relative to MP1-d, which is an identical construct except for the M→L substitution. This single amino acid change led to a 6-fold enhancement in luminescence and greatly reduced the temperature effect (compare MP1-dL to MP1-d). Indeed, the negative value at 8° C. for this mutant suggests that its optimum temperature has been shifted upwards to a level that is closer to RT than 8° C.

TABLE 7A

| | DLA | 8° C. |
|---|---|---|
| MP1-FL | 10.5 | 459.6% |
| MP1-d | 15.4 | 390.2% |
| MP1-dL | 92.2 | −8.8% |

These data show that improved performance can be achieved via a) deleting the region of MP1 upstream of NSDADRGKM and b) substituting an L for the M that lies immediately upstream of the conserved PGKK. To determine whether corresponding mutations in other members of the family provide similar benefits, the inventors selected a member of the other sub-family; iML22. In iML22 the corresponding region is DVDANRGGHGGH. As such, they created a deletion construct of iML22 (ML22d), which comprised the following truncated leader sequence; [(M) DVDANRGGHGGH-PGKK . . . ]. Notably, both iML22 and iMP2a comprise GHGGH in place of the KM of iMP1v1. Therefore, to test the benefit of an "L" mutation in iML22, they created a deletion plus L construct in which the GHGGH was converted to KL; (ML22dL1); (M)DVDANRGKL-PGKK . . . ]. Both of these constructs were tested in comparison to the full-length intracellular control [iML22] as described in Example 2/TABLE 5.

The data shown in FIG. 7B demonstrates that the corresponding mutations also benefit iML22.

TABLE 7B

| | DLA | 8° C. |
|---|---|---|
| ML22-FL | 1.2 | 2705% |
| ML22-d | 4.4 | 2593% |
| ML22-dL | 86.1 | 240% |

Next, the inventors constructed and tested the corresponding mutations in other family members; namely ML39, MP2a and ML45. For these experiments they also included mutants that comprise the "L" mutation, without the truncation (ML39-L, MP2a-L and ML45-L). Flash luminescence was also measured using both the DLA and F&G kits (which differ from each other greatly in composition) in order to confirm that the improved signal strength of the mutant luciferases is not restricted to any one assay buffer system.

TABLES 7C-E show that for each family member tested, significant benefit was obtained via either the deletion alone or the “L” alone. This benefit was apparent as an improved signal strength (in both assay buffers) and also as a shift in the temperature effect. Additionally, the data shows further benefit from combining the mutations.

TABLE 7C

| | F&G | DLA | 8° C. |
|---|---|---|---|
| ML39-FL | 32.0 | 4.0 | 981% |
| ML39-d | 72.0 | 11.7 | 673% |
| ML39-L | 172.3 | 30.4 | 97% |
| ML39-dL | 304.4 | 79.2 | 4% |

TABLE 7D

| | F&G | DLA | 8° C. |
|---|---|---|---|
| MP2a-FL | 9.3 | 4.6 | 1450% |
| MP2a-d | 27.1 | 12.4 | 872% |
| MP2a-L | 114.3 | 84.1 | 451% |
| MP2a-dL | 133.8 | 108.9 | 269% |

TABLE 7E

| (FLASH) | | | |
|---|---|---|---|
| | F&G | DLA | 8° C. |
| ML45-FL | 24.3 | 8.9 | 374% |
| ML45-d | 82.8 | 46.8 | 225% |
| ML45-L | 99.9 | 51.8 | 13% |
| ML45-dL | 404.4 | 278.6 | −34% |

As noted above, iML22 and iMP2a comprise GHGGH in place of the KM of the other *Metridia* luciferases; and the constructs ML22-dL, MP2a-L and MP2a-dL shown in TABLES 7B and 7D comprise a substitution of KL for the native GHGGH. To determine whether a simple substitution of the final H for L is sufficient to confer the advantage, the inventors constructed non-deleted mutants of these luciferases, in which the GHGGH is converted to GHGGL (MP2a-L2 and ML22-L2) and tested them as described in TABLE 6.

TABLE 8A shows that this single amino acid change is sufficient to improve the performance of these luciferases.

TABLE 8A

| | F&G | DLA | 8° C. |
|---|---|---|---|
| MP2a-FL | 24.0 | 13.9 | 978% |
| MP2a-L2 | 317.2 | 330.1 | 370% |
| ML22-FL | 10.9 | 3.0 | 3325% |
| ML22-L2 | 276.7 | 132.7 | 413% |

The effect of the M→L substitution was also tested in a secreted version of MP1. For this experiment, of course, the conditioned medium rather than the lysate was assayed. TABLE 8B shows that this M→L substitution also provides considerable benefit to the secreted luciferase.

TABLE 8B

| | DLA | F&G | 8° C. |
|---|---|---|---|
| wt sMP1 | 1,861 | 2,928 | −61.5% |
| M→L | 5,159 | 5,064 | −85.7% |

Example 4

Part IV: Optimising the Context of C6 in the Novel Intracellular Luciferases

During an extended search/screen for other beneficial mutations, the present inventors identified the amino acids flanking the $6^{th}$ cysteine (C6) as an important determinant of performance. Within this region the wild type luciferases have the following subsequences: LCVD, LCAD, RCTD, RCAS, RCTS, LCAT and LCED (see FIG. 1).

As a starting point for these studies, a mutant MP1v1 construct was used comprising a truncated leader sequence and the M->L mutation as described above. The inventors utilized the engineered XmaI, BsrGI, SalI, AgeI and HindIII restriction enzyme (RE) sites to create chimeras of this construct with portions of other family members and then tested performance as described in Example 2/TABLES. One chimera (designated Chi5), showed improved performance. This construct comprised the SalI-AgeI fragment of iML45, which includes the C6 region and results in a change of C6 context from LCAD to RCAS.

To determine whether RCAS was responsible for the improvement; and also to screen for further improvements via other alterations to this region the inventors constructed and tested mutants of Chi5 comprising a variety of different amino acid sequences in this region, as presented in TABLES 9A-9C below.

TABLE 9A

| | DLA | F&G | 10 m | 8o C. |
|---|---|---|---|---|
| $LC_6AD$ | 116.5 | 577.0 | 195.1 | 74.4% |
| $LC_6AS$ | 84.0 | 455.5 | 197.7 | 82.0% |
| $LC_6VD$ | 69.5 | 360.0 | 185.8 | 105.1% |
| $RC_6AD$ | 329.0 | >1000.5 | 595.6 | 42.1% |
| $RC_6TD$ | 193.5 | 869.0 | 356.5 | 111.6% |
| $RC_6TS$ | 156.0 | 745.0 | 282.2 | 138.7% |
| $RC_6AS$ | 220.0 | 793.0 | 445.6 | 82.0% |

TABLE 9B

| | DLA | F&G | 10 m | 8 C. |
|---|---|---|---|---|
| $QC_6SD$ | 265 | 399 | 69 | 207.2% |
| $QC_6AD$ | 389.1 | 551.5 | 115.3 | 82.9% |
| $HC_6AD$ | 293.0 | 502.2 | 58.9 | 197.5% |
| $KC_6AD$ | 419.4 | 749.5 | 139.0 | 68.0% |
| $RC_6AD$ | 367.2 | 711.2 | 153.7 | 24.8% |
| $RC_6ED$ | 444.2 | 791.0 | 160.7 | 22.9% |
| $RC_6HD$ | 231.4 | 482.4 | 102.0 | 91.3% |

TABLE 9C

| | DLA | F&G | 10 m | 8° C. |
|---|---|---|---|---|
| $RC_6AE$ | 262 | 730 | 96 | 120% |
| $RC_6AD$ | 329 | 853 | 138 | 106% |

The data presented in TABLE 9A show the following:

RCAS is responsible for the improvement seen in Chi 5; compare RCAS to LCAD.

An R in the first position is superior to an L; e.g. compare RCAS to LCAS and RCAD to LCAD.

An A in the third position is superior to a V, T or S; e.g., compare RCAD to RCTD and LCAD to LCVD and QCAD to QCSD.

A D in the fourth position is superior to a S; e.g., compare RCAD to RCAS

The optimum sequence is RCAD; compare RCAD to all others.

The data presented in TABLE 9B show the following:

In the first position, R, K, Q, and (to a lesser extent) H are all acceptable in that they provide better signal strength than L; compare KCAD, QCAD and HCAD to RCAD in TABLE 9B and compare this difference to the larger difference between RCAD and LCAD in TABLE 9A. With respect to the temperature effect, however, a marked difference was seen; with R showing the least increase at 8° C., followed by K, then Q and then H.

In the third position, an E is as good as (or better than) an A, whilst an H is clearly inferior; compare RCED, RCHD and RCAD.

The data presented in TABLE 9C show the following:

In the fourth position, an E provides good performance; compare RCAE to RCAD and compare this difference to the larger difference between RCAD and RCAS in TABLE 9A.

The combined data shows that improved performance can be attained by converting the C6 region to the following peptide formula; R/K/Q/H—C-A/E-D/E, which is not contained in any of the known luciferases.

Later it was sought to confirm that the same mutations provide benefit to members of the other subfamily. Therefore, the inventors created and tested mutants of iMP2a and iML22 (as described in Example 2) in which the C6 peptide was mutated to RCAD. The corresponding subsequences of the corresponding wild type luciferase sequences are LCVD in iMP2a and LCED in iML22.

TABLES 10A and 10B show that this mutation does indeed improve the performance of these luciferases.

TABLE 10A

| | | DLA | F&G | 10 m | 8° C. |
|---|---|---|---|---|---|
| iML22 | $LC_6ED$ (wt) | 2.27 | 3.80 | 0.13 | 3950.7% |
| | $RC_6AD$ | 3.80 | 13.02 | 0.36 | 3839.8% |

TABLE 10B

| | 101005 | DLA | F&G | 10 m | 8° C. |
|---|---|---|---|---|---|
| iMP2a | $LC_6VD$ (wt) | 8.09 | 7.92 | 0.12 | 2342.0% |
| | $RC_6AD$ | 36.80 | 48.43 | 0.58 | 1271.3% |

Additionally, the present inventors tested the benefit of the C6 mutation in the context of a secreted luciferase. For this experiment they utilized the secreted MP1v1 (sMP1v1) luciferase with an M→L substitution as described in TABLE 8B. The resultant data, shown in TABLE 10C, demonstrates that this mutation does indeed provide benefit to a luciferase in its secreted format.

TABLE 10C

| | | DLA | F&G | 10 m | 8° C. | 32° C. |
|---|---|---|---|---|---|---|
| sMP1v1 | $LC_6AD$ | 1,642 | 1,844 | 164 | −88.4% | −30.7% |
| M→L | $RC_6AD$ | 2,098 | 2,079 | 185 | −90.2% | −19.8% |

Example 5

Part V: Optimising the Context of C9 in the Novel Intracellular Luciferases

The inventors also searched for beneficial mutations within the amino acids flanking the $9^{th}$ cysteine (C9). Within this region the wild-type luciferases have the following subsequences: KCSA, KCSE, QCSD, HCSD and HCSA.

As a starting point for these studies, the mutant iMP1v1 construct was used, comprising RC6AD, the truncated leader sequence and M→L mutation as described above. The data are shown in TABLE 11.

TABLE 11A

| | DLA | F&G | 10 m | 8° C. |
|---|---|---|---|---|
| $KC_9AE$ | 31 | 99 | 20 | 151% |
| $KC_9SD$ | 157 | 520 | 94 | 116% |
| $KC_9SE$ | 144 | 375 | 71 | 101% |
| $RC_9AD$ | 10 | 19 | 21 | 114% |
| $RC_9AE$ | 14 | 34 | 33 | 94% |
| $RC_9SE$ | 94 | 307 | 42 | 81% |
| $KC_9SA$ | 132 | 350 | 58 | 146% |

TABLE 11B

| | DLA | F&G | 10 m | 8° C. |
|---|---|---|---|---|
| $QC_9AD$ | 31 | 48 | 56 | 97% |
| $QC_9SD$ | 252 | 612 | 101 | 175% |
| $RC_9AD$ | 45 | 66 | 76 | 35% |
| $KC_9SD$ | 266 | 772 | 138 | 86% |

The data depicted in TABLE 11 show the following:

A K in the first position is superior to an R or a Q; e.g., compare KCSE to RCSE and KCAE to RCAE in Table 11A; and KCSD to QCSD in TABLE 11B.

A S in the third position is superior to an A; e.g., compare KCSE to KCAE in TABLE 11A and QCSD to QCAD in TABLE 11B.

A D in the fourth position is superior to an A or E; e.g., compare KCSD to KCSA and KCSE in TABLE 11A The optimum sequence is KCSD; compare KCSD to all others.

The combined data show that improved performance can be obtained by converting the C9 region to KCSD that is not contained in any of the known luciferases.

Next, it was sought to confirm that the same modifications provide benefit to members of the other subfamily. Therefore, mutants of iMP2a and iML22 (as described in Example 2), were created and tested in which the C9 peptide was mutated to KCSD. The corresponding peptides of the wild type luciferases are HCSA in iMP2a and HCSD in iML22. Thus, the iML22 mutation also serves to compare K to H in the first position.

TABLE 12 shows that this mutation does indeed improve the performance of these luciferases. Additionally, the data show that a K in the first position is superior to a H; compare iML22-KCSD to iML22-HCSD in TABLE 12A.

TABLE 12A

| | | DLA | AB9 | 10 m | 8° C. |
|---|---|---|---|---|---|
| iML22 | $HC_9SD$ (wt) | 2.27 | 3.80 | 0.13 | 3950.7% |
| | $KC_9SD$ | 7.28 | 18.85 | 0.36 | 3104.1% |

TABLE 12B

| | | DLA | AB9 | 10 m | 8° C. |
|---|---|---|---|---|---|
| iMP2a | $HC_9SA$(wt) | 8.09 | 7.92 | 0.12 | 2342.0% |
| | $KC_9SD$ | 28.07 | 48.44 | 0.48 | 1898.3% |

Example 6

Part VI: Optimising the Context of C5 in the Novel Intracellular Luciferases The present inventors also searched for beneficial mutations within the amino acids flanking the $5^{th}$ cysteine (C5). Within this region the wild type luciferases have the following subsequences: RCHD, RCHT and RCHS.

As a starting point for these studies a mutant iMP1v1 construct was used comprising a truncated leader sequence, the M→L mutation, and RC6AD as described above. The data are presented in TABLE 13A.

TABLE 13A

| | DLA | F&G | 10 m | 8° C. |
|---|---|---|---|---|
| $RC_5HD$ | 1,028 | 974 | 173 | 116% |
| $RC_5AD$ | 1,685 | 1,671 | 200 | 19% |

Additionally, they used as a starting point a mutant iMP1v1 construct comprising the same mutations but also comprising KC9SD as described above. The data are presented in TABLE 13B

TABLE 13B

| | DLA | F&G | 10 m | 8° C. |
|---|---|---|---|---|
| RC5HD | 1314 | 1387 | 268 | 104% |
| RC5AD | 1738 | 1959 | 287 | 25% |

The data shown in TABLE 13 demonstrate that a single amino acid change from H to A is sufficient to provide substantially improved performance. This is particularly surprising considering that the native H at this position is conserved amongst all of the wild-type luciferases.

Whereas all members of sub-family 1 comprise RC5HD, the members of subfamily 2 comprise RCHT (Gaussia) or RCHS (MP2a and ML22). The inventors constructed mutants of MP2a-L2 in which the native RCHS was converted to RCAS, RCAT or RCAD; and tested them as described above. The data is shown in TABLE 13C.

TABLE 13C

| | DLA | F&G | 10 m | 8° C. |
|---|---|---|---|---|
| $RC_5HS$ | 53.0 | 61.4 | 0.68 | 416% |
| $RC_5AS$ | 102.1 | 87.0 | 0.72 | 230% |
| $RC_5AT$ | 96.5 | 138.3 | 1.02 | 201% |
| $RC_5AD$ | 75.0 | 69.8 | 0.76 | 301% |

The data shown in TABLE 13C demonstrate that the single amino acid change from H to A is also sufficient to provide substantially improved performance in this luciferase. Additionally, all 3 permutations (RCAS, RCAT and RCAD) provided performance benefits.

Example 7

Part VII: Further Optimisation of the N-Terminal (Leader) Sequence

Amongst the many synthetic leader sequences tested, one that performed very well was EAEAERGKL. The inventors cloned this leader and various mutations thereof into the RC5AD construct described in TABLE 13B [i.e., mutant iMP1v1 with RC5AD, RC6AD and KC9SD] and tested their performance as described in Examples 2-6. The data are shown in TABLE 14.

TABLE 14A shows the performance effects of further truncations of the leader sequence. Even the longest truncation, which extended all the way to the critical L (construct=M-L-PGKK . . . ) yielded a functional luciferase; although better performance was achieved with inclusion of the 2-6 amino acids that lie immediately upstream of this residue.

TABLE 14B includes some of these same deletion constructs as well as constructs comprising amino acid substitutions. Notably, mutation of the critical "L" to a V, or even the more conservative change to an I, caused a very substantial drop in performance. Indeed, the performance of these mutants was worse than that of the longest truncation (to L alone). Including amino acids upstream of the critical L (e.g., ERGK) improved performance, though other mutants suggested that the R and K within this motif can tolerate substitutions (e.g., R→A and K→G).

TABLE 14C shows the effect of other substitutions for the critical L. A very substantial drop in performance was seen when this L was substituted with a A, F, H, P or T.

TABLE 14A

| | DLA | F&G | 10 m | 8° C. |
|---|---|---|---|---|
| EAEAERGKL | 494 | 747 | 195 | −57.3% |
| AEAERGKL | 508 | 711 | 190 | −62.5% |
| EAERGKL | 438 | 636 | 181 | −62.2% |
| ERGKL | 361 | 530 | 156 | −60.8% |
| GKL | 175 | 285 | 89 | −67.0% |
| L | 97 | 222 | 64 | −57.1% |

TABLE 14B

| | DLA | F&G | 10 m | 8° C. |
|---|---|---|---|---|
| EAEAERGKL | 704 | 828 | 222 | −72.0% |
| EAEAERGKI | 100 | 219 | 73 | 49.7% |
| EAEAERGKV | 64 | 144 | 52 | 100.6% |
| EAEAERGGL | 748 | 738 | 196 | −56.3% |
| EAEAGKL | 544 | 721 | 177 | −61.8% |

TABLE 14C

| | DLA | F&G | 10 m | 8° C. |
|---|---|---|---|---|
| EAEAERGKL | 540.9 | 1,179.5 | 221.3 | −68.2% |
| EAEAERGKA | 44.1 | 194.9 | 60.0 | 129.3% |
| EAEAERGKF | 47.5 | 195.4 | 80.3 | 83.1% |
| EAEAERGKH | 40.7 | 192.4 | 59.0 | 248.7% |
| EAEAERGKP | 56.3 | 283.0 | 82.1 | 124.3% |
| EAEAERGKT | 57.5 | 310.8 | 86.6 | 127.1% |
| EAEAERGKY | 22.4 | 127.6 | 39.6 | 265.8% |

TABLE 14D

| | DLA | F&G | 10 m | 8° C. | 32° C. |
|---|---|---|---|---|---|
| M | 24.9 | 84.2 | 19.3 | 264.4% | −85.1% |
| ML | 133.9 | 280.2 | 76.0 | −75.1% | −54.9% |
| MKL | 117.4 | 249.7 | 63.1 | −66.0% | −47.6% |
| MGKL | 175.6 | 299.5 | 73.5 | −68.4% | −41.1% |
| MRGKL | 50.5 | 169.6 | 40.3 | −70.0% | −44.6% |
| MERGKL | 418.3 | 684.7 | 156.8 | −64.9% | −50.6% |
| MGGHGGH | 20.4 | 65.2 | 17.22 | 244.2% | −86.6% |
| MGGHGGL | 215.0 | 472.6 | 110.1 | −56.1% | −54.8% |
| MGGL | 89.9 | 203.5 | 49.1 | −56.2% | −53.3% |

Example 8

Part VIII: Optimising the Context of C10 in the Novel Intracellular Luciferases The present inventors also searched for beneficial mutations within the amino acids flanking the $10^{th}$ cysteine (C10). Within this region the wild type luciferases have the following peptides; DRCAS, QRCAT, SRCKT and GRCAS.

As a starting point for these studies the mutant iMP1v1 construct was used with the EAEAERGKL leader as described in TABLE 14 [i.e., also containing RC5AD, RC6AD, KC9SD]. Various modifications around C10 were tested and one mutant demonstrated enhanced performance. This mutant, designated GRC10AS in TABLE 15A [and designated Clone 21 in TABLE 16], comprised a D→G substitution at the second residue upstream of C10. The data shows that this substitution results in enhanced flash signal in DLA, a slightly lower flash signal in Flash & Glow (F&G) and notably, a larger loss of activity at 8° C. This latter feature suggests a further rise in optimum temperature to a level well above 8° C. Therefore, an additional temperature experiment was performed in which the plates were moved into a 32° C. incubator. The data show that the D→G mutation reduces the loss in signal when the sample is heated to 32° C.

TABLE 15A

| | DLA | F&G | 10 m | 8° C. | 32° C. |
|---|---|---|---|---|---|
| $DRC_{10}AS$ | 497.6 | 778.3 | 196.2 | −74.5% | −41.2% |
| $GRC_{10}AS$ | 937.5 | 611.9 | 189.2 | −91.3% | −24.3% |

Based on the surprising results of TABLE 15A, the present inventor tested additional modifications to the second residue upstream of the C10 position and present the results in TABLE 15B and 15C.

TABLE 15B

| | DLA | F&G | 10 m | 8° C. | 32° C. |
|---|---|---|---|---|---|
| $DRC_{10}AS$ | 357 | 568 | 147 | −65.7% | −41.3% |
| $NRC_{10}AS$ | 695 | 626 | 153 | −83.4% | −23.9% |
| $SRC_{10}AS$ | 704 | 584 | 120 | −81.0% | −31.1% |
| $ARC_{10}AS$ | 594 | 451 | 141 | −83.4% | −23.9% |
| $TRC_{10}AS$ | 671 | 556 | 149 | −83.8% | −19.1% |
| $QRC_{10}AS$ | 587 | 496 | 159 | −87.2% | −23.7% |
| $GRC_{10}AS$ | 704 | 474 | 141 | −88.2% | −22.8% |
| $GRC_{10}AT$ | 805 | 500 | 158 | −90.0% | −23.4% |
| $QRC_{10}AT$ | 732 | 610 | 185 | −88.4% | −11.8% |
| $SRC_{10}KT$ | 387 | 329 | 78 | −89.3% | −24.3% |

TABLE 15C

| | DLA | F&G | 10 m | 8° C. | 32° C. |
|---|---|---|---|---|---|
| $DRC_{10}AS$(wt) | 758 | 1,157 | 238 | −61.77% | −45.80% |
| $GRC_{10}AS$ | 952 | 584 | 155 | −86.12% | −32.98% |
| $ERC_{10}AS$ | 1,345 | 1,255 | 320 | −89.59% | −26.48% |
| $HRC_{10}AS$ | 1,042 | 907 | 150 | −60.78% | −36.28% |
| $KRC_{10}AS$ | 464 | 463 | 152 | −82.35% | −35.19% |
| $PRC_{10}AS$ | 26 | 58 | 4 | 144.44% | −57.92% |
| $RRC_{10}AS$ | 462 | 439 | 147 | −82.73% | −35.39% |
| $TRC_{10}AS$ | 939 | 724 | 163 | −81.59% | −24.83% |
| $QRC_{10}AT$ | 891 | 720 | 184 | −88.77% | −16.20% |
| $GRC_{10}AT$ | 1,073 | 731 | 202 | −88.85% | −21.32% |

The data in TABLE 15B and TABLE 15C demonstrate that performance enhancements can be obtained by substituting D for any of; G, N, S, A, T, Q, E, H, K and R. These data also show that substitution of T for the S in the DRC10AS motif provides further benefit. Additionally, the data shows that the SRC10KT motif (present in MP2a and ML22) can be improved by substituting an A for the K.

Next, the inventors constructed and tested similar mutations in nsMP2a. The data is shown in TABLE 15D.

TABLE 15D

| | DLA | F&G | 10 m | 8° C. | 32° C. |
|---|---|---|---|---|---|
| $QRC_{10}AT$ | 94.6 | 190.8 | 1.23 | 1538.1% | −84.5% |
| $TRC_{10}AT$ | 32.5 | 89.3 | 0.98 | 1582.1% | −83.0% |
| $GRC_{10}AS$ | 114.2 | 167.3 | 1.19 | 1180.5% | −85.0% |
| $GRC_{10}AT$ | 147.1 | 221.1 | 1.81 | 985.9% | −81.8% |
| $GRC_{10}KT$ | 59.3 | 87.4 | 0.73 | 1467.5% | −79.9% |
| $SRC_{10}KT$ (wt) | 17.8 | 34.4 | 0.27 | 2025.5% | −81.5% |

TABLE 15D demonstrates that the performance of nsMP2a can also be improved via substitution of G for S in the SRC10KT motif to generate GRC10KT. Further substitution of A for K to generate GRC10AT provided additional benefit.

Next, we tested the benefit of a C10 mutation in nsMP1; i.e. in a construct that contained none of the other beneficial mutations. The results are shown in TABLE 15E and indicate that substitution of G for D also provides considerable benefit in the absence of other mutations.

TABLE 15E

| | DLA | F&G | 10 m | 8° C. | 32° C. |
|---|---|---|---|---|---|
| MP1 $DRC_{10}AS$(wt) | 10 | 25 | 17 | 297.9% | −84.9% |
| MP1 $GRC_{10}AS$ | 116 | 181 | 45 | 7.7% | −70.4% |

Example 9

Part IX: Comparative Performance of Synthetic Luciferases of the Invention

To quantify the performance benefits of combining the mutations described above, the inventors tested the 6 different full length (wt) intracellular luciferases together with the GRC10AS clone described in TABLE 15, that was designated Clone 21. Clone 21 comprises the following mutations:

leader peptide truncation and M→L substitution (MEAEAERGKL)

RC6AD

KC9SD

RC5AD

GRC10AS

The data are shown in TABLE 16A and demonstrate a massive improvement in all measures of signal intensity and a substantial rise in optimum temperature that led to a greatly reduced effect of warming from RT to 32° C.

TABLE 16A

| | DLA | F&G | 10 m | 8° C. | 32° C. |
|---|---|---|---|---|---|
| ML22 | 0.61 | 1.70 | 0.11 | 2731.7% | −57.4% |
| MP2a | 2.61 | 3.31 | 0.11 | 983.7% | −64.9% |
| ML39 | 5.36 | 17.85 | 5.78 | 737.6% | −79.7% |
| ML164 | 1.65 | 7.14 | 10.25 | 207.2% | −78.4% |
| ML45 | 4.71 | 17.60 | 15.50 | 152.2% | −76.3% |
| MP1 | 7.40 | 30.82 | 11.99 | 388.5% | −82.2% |
| Ga | 273.44 | 182.12 | 35.81 | 88.4% | −68.2% |
| clone 21 | 1,014.19 | 600.81 | 173.52 | −90.9% | −23.1% |

To confirm that the benefit of these mutations is not limited to luciferases comprising a PEST sequence, the PEST sequences were removed from Clone 21 and the performance of the original iMP1v1 was tested and compared. TABLE 16B shows that considerable benefit is attained, even in the absence of PEST sequences.

TABLE 16B

| | DLA | F&G | 10 m | 8° C. | 32° C. |
|---|---|---|---|---|---|
| MP1 no PEST | 55.2 | 173.9 | 48.7 | 197.2% | −79.0% |
| CI-21 no PEST | 2,216.6 | 1,201.3 | 231.6 | −89.7% | −20.7% |

TABLE 16C

| | ML164 | Ga | MP1 | ML45 | ML22 | MP2a | ML39 | 21-GRCAT |
|---|---|---|---|---|---|---|---|---|
| 19° C. | 39.3% | 13.9% | 62.9% | 24.3% | 44.3% | −6.7% | 61.6% | −12.7% |
| 27° C. | −70.6% | −53.8% | −77.1% | −71.4% | −60.8% | −68.3% | −77.8% | −11.0% |

To quantify the benefit of these mutations in a defined assay buffer system an assay was performed using the v6 lysis buffer and assay buffer comprising 25 mM Tris pH 7.75, 0.6 mM reduced glutathione, 0.4 mM oxidized glutathione, 1 mM EDTA, 2 mM Ascorbate, 24 μM Cz as defined in Example 28 of WO 2008/049160. TABLE 17 shows that the considerable benefit of these mutations in terms of both signal strength and temperature effect also applies to assays using these reagents. Clone 22 is the same as Clone 21, except that it contains GRC10AT. Clone 16 is the same as Clone 21, except that it contains DRC10AS.

TABLE 17

| | DLA | v6 | 10 m | 8° C. | 32° C. |
|---|---|---|---|---|---|
| ML39 | 7.0 | 14.5 | 3.6 | 633.7% | −53.8% |
| MP1 | 10.6 | 24.2 | 9.6 | 488.9% | −71.4% |
| ML164 | 1.6 | 4.1 | 6.5 | 243.0% | −57.1% |
| ML45 | 6.5 | 15.1 | 11.5 | 236.4% | −67.9% |
| Gs | 398.3 | 580.9 | 67.6 | 32.7% | −64.3% |
| CI-16 | 877.7 | 1,146.5 | 252.4 | −20.8% | −49.7% |
| CI-21 | 1,223.8 | 1,066.3 | 281.4 | −59.0% | −33.9% |
| CI-22 | 1,180.6 | 1,057.7 | 316.9 | −62.5% | −31.2% |

To quantify the benefit of these mutations in the context of secreted luciferases, the inventors performed assays on secreted versions (which lack a PEST sequence) using the same methodology as for intracellular protein described previously. The results are shown in TABLE 18A and 18B, and confirm the benefit of the inventor's discovery is applicable in both intracellular and secreted luciferases.

TABLE 18A

| | F&G | 10 m | 8° C. | 32° C. |
|---|---|---|---|---|
| sGa no PEST | 169.7 | 13.5 | 49.56% | −60.2% |
| sML164 no PEST | 17.8 | 12.6 | 3.14% | −66.7% |
| sCI-16 no PEST | 1,234.3 | 34.0 | −78.17% | −24.6% |
| sCI-16 MP1L Is no PEST | 2,075.5 | 94.1 | −78.89% | −31.3% |

TABLE 18B

| | DLA | F&G | 10 m | 8° C. | 32° C. |
|---|---|---|---|---|---|
| sMP1 no PEST | 903 | 2243 | 1095 | −53.7 | −70.06 |
| sCI16-MP1L Is noPEST | 3,934 | 4,221 | 2275 | −82.5% | −0.05% |

To demonstrate the benefits of the inventor's mutations on secreted luciferases, sequential loss of benefit mutations were generated to demonstrate benefits as shown in TABLE 18C and 18D. In TABLE 18C& 18D, sMP1 mutations are labeled as follows: L=M−L substitution; C6=RC6AD; C9=KC9SD; C5=RC5AD; C10=GRC10AS; Truncated=GSEAEAERGKL after the signal peptide. Of particular note is the response to 32° C., which indicates that each and every successive mutation raises the optimum temperature of the luciferase.

TABLE 18C

| | | DLA | F&G | 10 m | 8° C. | 32° C. |
|---|---|---|---|---|---|---|
| wt MP1 | | 903 | 2,243 | 219 | −60.4% | −71.7% |
| −5 | L | 3,050 | 4,301 | 389 | −79.8% | −29.2% |
| −4 | L ME | 3,350 | 4,831 | 398 | −78.1% | −33.2% |
| −3 | L ME C6 | 3,731 | 4,199 | 299 | −85.4% | −25.2% |
| −2 | L ME C6 C9 | 3,541 | 3,936 | 313 | −89.2% | −23.5% |
| −1 | L ME C6 C9 KK | 3,232 | 3,467 | 275 | −83.2% | −16.7% |
| 0 | L ME C6 C9 KK C5 | 3,934 | 4,221 | 228 | −82.5% | 0.0% |
| −3GRC10AS | L ME C6 C10 | 4,097 | 2,519 | 200 | −94.1% | 36.7% |

TABLE 18D

| | | DLA | F&G | 10 m | 8° C. | 32° C. |
|---|---|---|---|---|---|---|
| 0 | L ME C6 C9 KK C5 | 1,428 | 1,286 | 71 | −86.70% | 0.37% |
| truncation | L ME C6 C9 KK C5 trunc | 461 | 301 | 22 | −86.77% | 9.28% |

To quantify the performance benefits of combining the mutations described above, the inventors tested the 6 different full length (wt) secreted luciferases together with mutants described in TABLE 18C and 18D.

The data is shown in TABLE 19A and demonstrates a enormous improvement in all measures of signal intensity and a substantial rise in optimum temperature that led to a greatly reduced effect of warming from RT to 32° C.

TABLE 19A

| | | DLA | AB9 | 10 m | 8 C. | 32 C. |
|---|---|---|---|---|---|---|
| Ga | wt | 1,054 | 498 | 51 | 6.58% | −59.67% |
| ML164 | wt | 20 | 67 | 47 | −14.04% | −71.72% |
| MP1 | wt | 835 | 2,073 | 202 | −60.4% | −71.7% |
| −5 | L | 3,049 | 4,301 | 389 | −79.8% | −29.2% |
| −4 | L ME | 3,754 | 4,830 | 397 | −78.1% | −33.2% |
| −3 | L ME C6 | 3,949 | 4,318 | 297 | −85.4% | −25.2% |
| −2 | L ME C6 C9 | 3,541 | 3,936 | 313 | −89.2% | −23.5% |
| −1 | L ME C6 C9 KK | 3,231 | 3,467 | 275 | −83.2% | −16.7% |
| 0 | L ME C6 C9 KK C5 | 3,934 | 4,225 | 228 | −82.5% | 0.0% |
| −3GRC10AS | L ME C6 C10 | 4,350 | 2,721 | 217 | −94.1% | 36.7% |

In addition, to confirm that the benefits are not dependent on buffer composition, the inventors assayed the conditioned medium via an assay buffer that comprised only medium (RPMI) and coelenterazine.

The data is shown in TABLE 19B and demonstrates a enormous improvement in all measures of signal intensity and a substantial rise in optimum temperature that led to a greatly reduced effect of warming from RT to 32° C.

TABLE 19B

| RPMI & CTZ | | 10 m | 8° C. | 32° C. |
|---|---|---|---|---|
| Ga | wt | 24 | 38.7% | −52.9% |
| ML164 | wt | 23 | 162.0% | −55.6% |
| MP1 | wt | 97 | 148.8% | −81.5% |
| −5 | L | 269 | 8.2% | −70.9% |
| −4 | L ME | 257 | 19.1% | −71.7% |
| −3 | L ME C6 | 206 | −14.5% | −67.8% |
| −2 | L ME C6 C9 | 198 | −20.2% | −70.4% |
| −1 | L ME C6 C9 KK | 183 | −18.7% | −63.5% |

TABLE 19B-continued

| RPMI & CTZ | | 10 m | 8° C. | 32° C. |
|---|---|---|---|---|
| 0 | L ME C6 C9 KK C5 | 489 | −30.6% | −65.5% |
| −3GRC10AS | L ME C6 C10 | 307 | −75.6% | −44.6% |

Next, the inventors sought to quantify the benefits of the improved temperature response in the context of a temperature range that more closely resembles the potential range of temperatures to which a "room temperature" sample could be exposed. To this end, the inventors modified our standard temperature assay from 8° C./32° C. to 19° C./27° C. Note that these are the temperatures immediately prior to moving the plates into the luminometer, such that some level of temperature equilibration would occur prior to measurement; thus reducing the true temperature range even further. The data is shown in TABLE 20A

TABLE 20A

| | nsML164 | nsGa | nsMP1 | nsML45 | nsML22 | nsMP2a | nsML39 | CI-21 |
|---|---|---|---|---|---|---|---|---|
| 19° C. | 39.3% | 13.9% | 62.9% | 24.3% | 44.3% | −6.7% | 61.6% | −12.7% |
| 27° C. | −70.6% | −53.8% | −77.1% | −71.4% | −60.8% | −68.3% | −77.8% | −11.0% |

TABLE 20A shows that the luminescence of Clone-21 (Cl-21) deviated from the true RT measurement by less than 13% when either cooled to 19° C. or warmed to 27° C. In stark contrast to this, all wild-type intracellular luciferases showed a substantially greater variation in luminescence in response to these temperature changes.

To further define the optimum temperatures of the non-secreted luciferases and their response to temperature changes, the inventors plated lysates in replicate 96-well plates and initiated glow reactions with the F&G assay buffer. One plate was then moved into a fridge to cool while the control plate remained at RT. Both plates were then measured repeatedly and the temperature of the assay reaction was monitored immediately prior to each read. As the cooled plate reached room temperature, it was moved in and out of a 37° C. oven in order to obtain the higher temperature reads. Data are shown in FIG. 2 as the luminescence of the temperature adjusted plate relative to the control (RT) plate.

Figure 2:
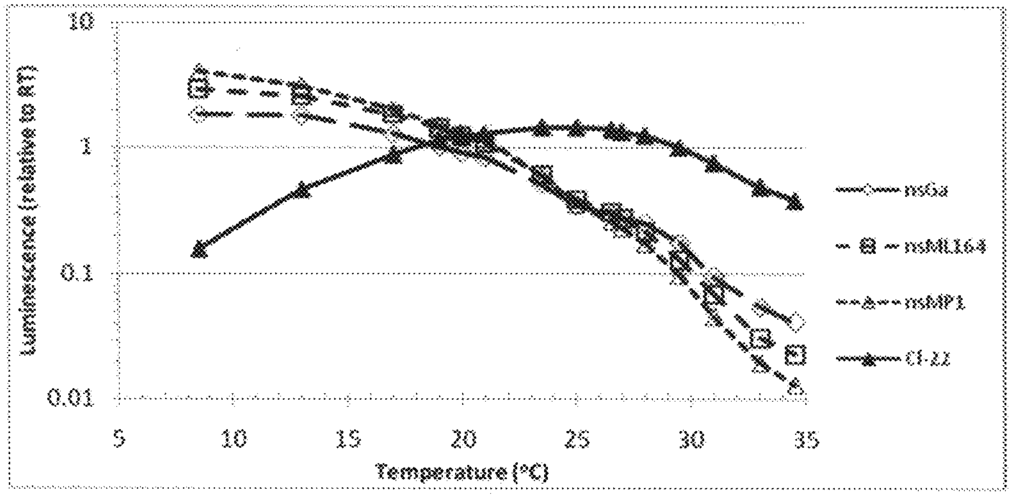
FIG. 2 is a graphical representation showing Glow F&G of lysates from fridge-RT-oven (relative to control RT plate).

FIG. 2 shows that, compared to the w.t. luciferases and Clone 22, Clone 22 comprises the following mutations:

leader peptide truncation and M→L substitution (MEAEAERGKL)

RC6AD

KC9SD

RC5AD

GRC10AT

Clone 22 (undergoes only minimal changes in luminescence as the temperature changes within the range of 18-28° C. This is an important temperature range for assays conducted on a laboratory bench, where RT can vary and where some heating above RT is unavoidable due to the heat generated by the electronics within the luminometer; e.g., temperature within the inventors' luminometer can rise as high as 27° C. during extended operation.

Next the inventors measured temperature effect in flash reactions. Lysates were loaded onto a 96-well plate (32 replicate samples for each luciferase) and cooled in a fridge prior to moving the plate into the luminometer for measurement via flash reactions following automatic injection of RT assay buffer. Inside the luminometer, these lysates are warmed by heat from the luminometer such that each consecutive sample of a particular type of lysate is slightly warmer than the preceding sample of the same type. Data were expressed as the luminescence of each individual sample, relative to the mean luminescence of all 32 samples of that type and are shown in FIG. 3.

Figure 3:
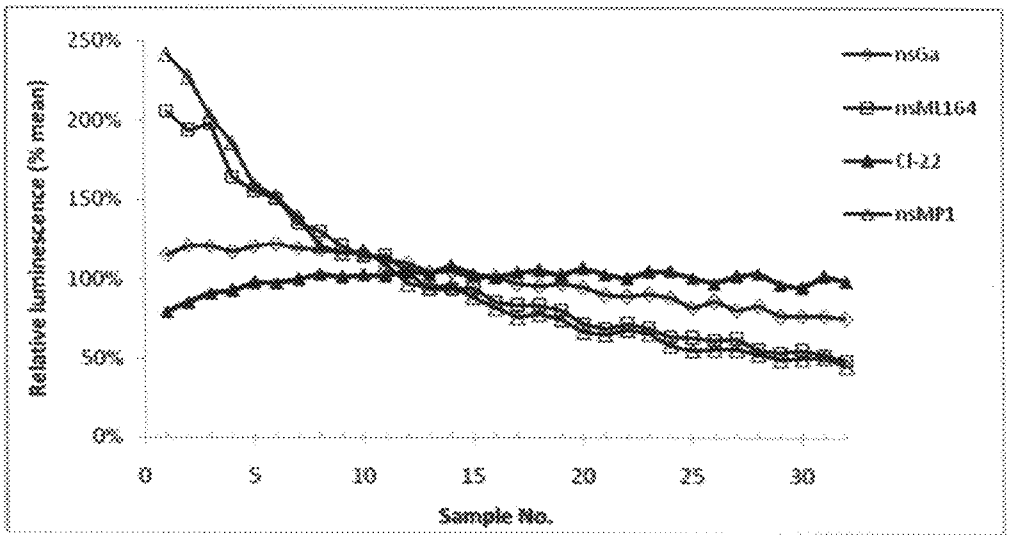
FIG. 3 is a graphical representation showing Flash DLA plate of lysates from fridge to machine for injection of RT assay buffer.

FIG. 3 shows a remarkably large variation in luminescence intensity for each of the w.t. (but non-secreted) luciferases, despite the fact that only the temperature of the lysates (and not the assay buffer) varies during an experiment of this type. In contrast, much less variation was seen with Clone 22.

These data indicate that assays using Clone 22 would benefit from reduced temperature-mediated errors, even if the user fails to properly warm the lysates to RT prior to measurement.

Figure 4:
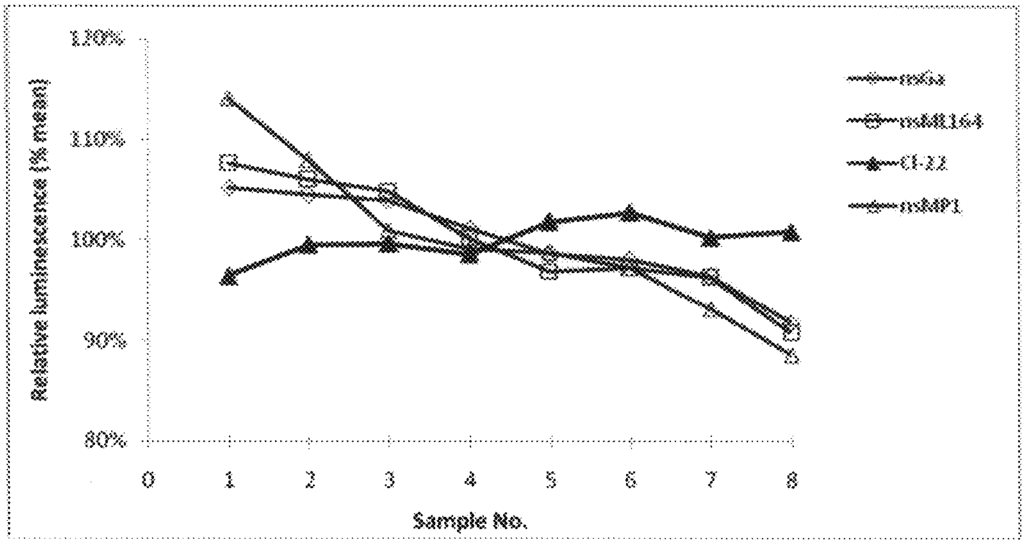
FIG. 4 is a graphical representation showing Glow F&G at 21° C. into machine (end temperature increased by 0.5° C.).

Next, the inventors tested the effect of this unavoidable heating within the luminometer using glow reactions and a plate that was maintained at 21° C. prior to being placed in the luminometer for measurement. Replicate lysates were loaded onto a 96-well plate and a glow reaction initiated with F&G assay buffer. The temperature of the reactions was measured as being 21° C. immediately prior to inserting the plate in the luminometer for measurement. Data were expressed as the luminescence of each individual sample, relative to the mean luminescence of all samples of that type and are shown in FIG. 4.

FIG. 4 demonstrates, once again, that less variation (and therefore less error) occurs with Clone 22 compared to any of the w.t. (non-secreted) luciferases.

Finally, the inventors measured temperature effect on secreted versions of the luciferases by performing an experiment similar to that described in FIG. 2, except using conditioned medium that contains the indicated w.t. and mutant luciferases. The mutations of iMP1v1 are indicated as in TABLE 15D (i.e., L=M–L substitution; C6=RC6AD; C9=KC9SD; C5=RC5AD; C10=GRC10AS). The resultant data are shown in FIG. 5.

Figure 5:
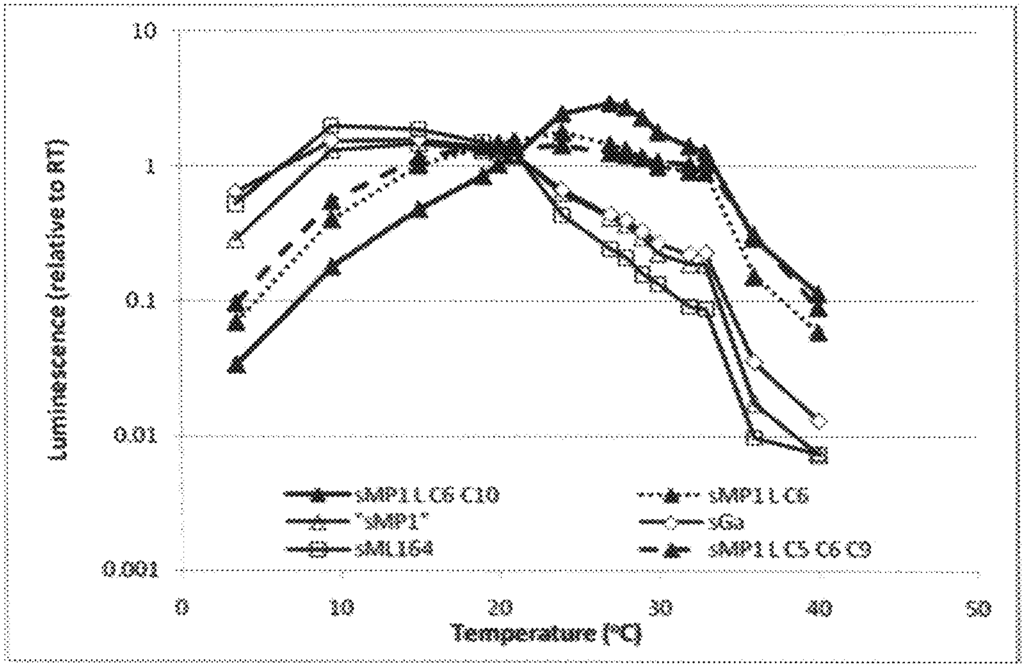
FIG. 5 is a graphical representation showing Glow F&G of conditioned media from fridge-RT-oven (relative to control RT plate).

FIG. 5 illustrates the much higher optimum temperature of the mutant luciferases and their improved resistance to higher temperatures; e.g., above 21° C. and above 33° C. At the highest temperature (40° C.), the mutant luciferases retained about 10-fold more of their activity.

Example 10

Further Temperature Range-Elevating Modifications

Since previous described examples demonstrated a marked increase in the optimal temperature of a luciferase through a M→L substitution immediately upstream of the conserved PGKK residues, the present inventors sought to determine whether other M→L substitutions would also increase optimum temperature. To this end, a secreted luciferase, designated Clone 25 (comprising the mutations of Clone 22) was mutated at the M corresponding to position 98 in FIG. 1. The variants were tested in luciferase assays as per Example 8 (using conditioned medium as the luciferases were in secreted form) and the results are shown in Table 21A.

TABLE 21A

| secreted CI25 | DLA | F&G | 10 m | 8° C. | 32° C. |
|---|---|---|---|---|---|
| L | 113.3 | 59.0 | 0.18 | −96.7% | 221.8% |
| M | 110.7 | 62.4 | 0.45 | −93.0% | 63.2% |
| I | 93.3 | 43.6 | 0.07 | −89.3% | 69.5% |
| V | 93.1 | 55.3 | 0.1 | −90.4% | 78.0% |
| A | 25.3 | 17.1 | 0.27 | −96.6% | 48.3% |

TABLE 21A shows that replacing the M with L, I or V but not A generated a mutant luciferase with a greater rise in luminescent signal at 32° C., relative to room temperature, indicating an increase in the optimal temperature. The largest rise was seen in the mutant with the M→L substitution.

Figure 6:
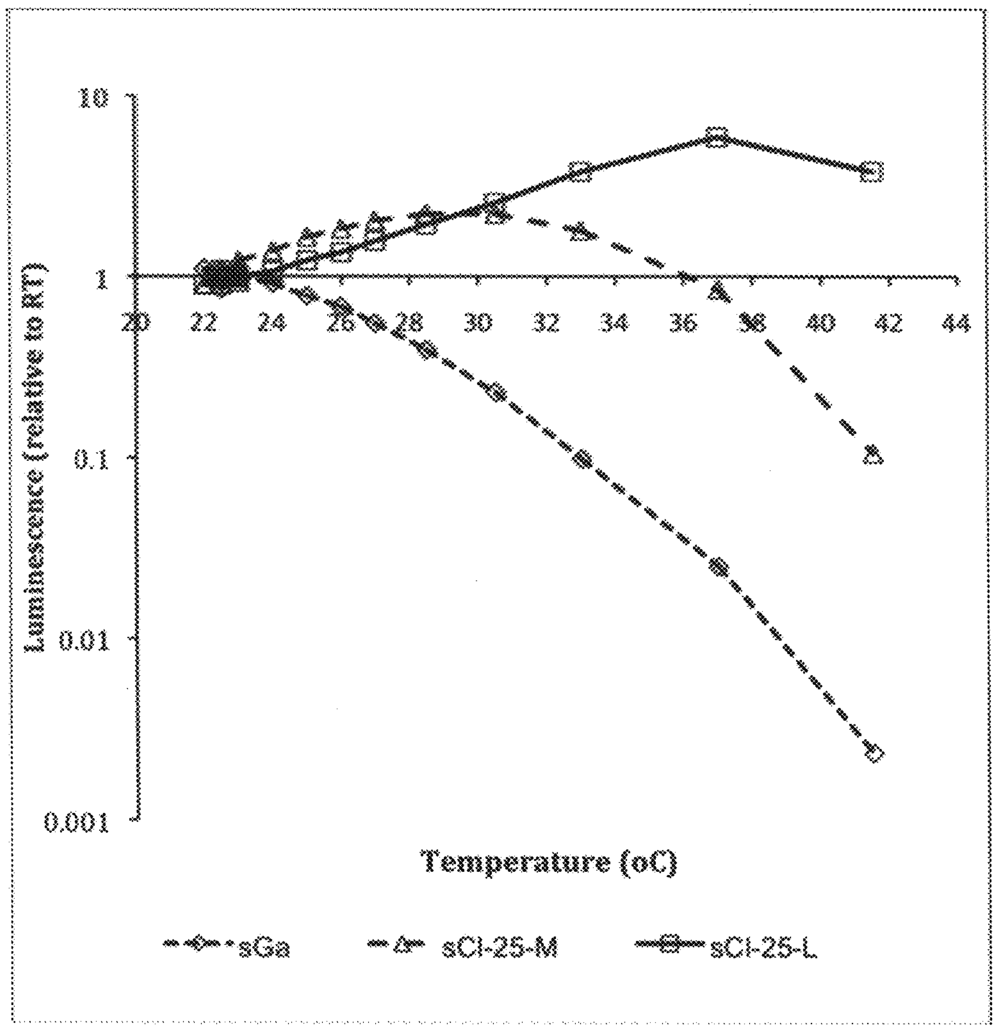
FIG. 6 is a graphical representation showing glow F&G luciferase data across a range of temperatures.

This rise in optimum temperature was further defined in an optimum temperature experiment performed as per Example 9, FIG. 5. The results are shown in FIG. 6 and demonstrate that the M→L variant of Clone 25 (sCl-25-L) has an optimum temperature of about 37° C., compared to ~29° C. in Clone 25 without that modification (sCl-25-M). Furthermore, these luciferases displayed a >10- and >20-fold, respectively, higher activity than wild-type secreted *Gaussia* luciferase (sGa) at the highest temperature (41° C.) assayed.

The effect of the M→(L, I, V or A) modification was also tested in an intracellular version of the Cl25 luciferase. For this experiment, of course, lysate rather than conditioned medium was assayed. TABLE 21B shows that this M→(L, I or V) modification also provides considerable benefit in the context of an intracellular luciferase; e.g. larger rise in luminescence at 32° C. Similar to that seen with the secreted luciferase, the M→L modification provided the greatest rise and the M→A substitution did not raise the optimum temperature.

TABLE 21B

| intracellular CI-25 | DLA | F&G | 8° C. | 32° C. |
|---|---|---|---|---|
| L | 29.5 | 14.8 | −97.8% | 285.5% |
| M | 18.7 | 11.5 | −93.8% | −21.1% |
| I | 19.9 | 11.9 | −96.0% | 183.1% |
| V | 7.9 | 7.5 | −97.1% | 89.2% |
| A | 1.4 | 1.8 | −93.2% | −34.0 |

Example 8 (see Table 15C) showed that the residue, 2 amino acids upstream of C10, influences optimum temperature and that an E at this position was one desirable embodiment. The inventors therefore sought to determine whether substituting in an E at the corresponding position relative to C6 would provide similar benefit. The DRC6AD motif of the both the M and L versions of secreted Clone 25 were converted to ERC6AD and tested as described above. The results are shown in Table 21C, which demonstrates a further rise in optimal temperature via this D→E modification.

TABLE 21C

| secreted CI-25 | DLA | FBG | 10 m | 32° C. |
|---|---|---|---|---|
| M + ERC6AD | 98.0 | 75.5 | 0.49 | 56.4% |
| M + DRC6AD | 134.0 | 84.5 | 0.71 | 41.2% |
| L + ERC6AD | 138.0 | 90.0 | 0.41 | 218.5% |
| L + DRC6AD | 146.0 | 86.0 | 0.37 | 170.8% |

The disclosure of every patent, patent application, and publication cited herein is hereby incorporated herein by reference in its entirety.

The citation of any reference herein should not be construed as an admission that such reference is available as “Prior Art” to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

SEQUENCE LISTING (905 sequences)

SEQ ID NO: 1 - skipped

SEQ ID NO: 2 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 3 - skipped

SEQ ID NO: 4 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKDEL

SEQ ID NO: 5 - skipped

SEQ ID NO: 6 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 7 - skipped

SEQ ID NO: 8 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDLCVDCTTGCLKGLANVQCSDLLKKWLPQRCATFASKIQGQVDKIKGAGGD

SEQ ID NO: 9 - skipped

SEQ ID NO: 10 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 11 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggnytnccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 12 - protein, 189 aa, Metridia pacifica
MGVKLIFAVLCVAAAQAATINENFEDIDVVAIGGSFALDVDANRGGHGGLPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 13 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggnytnccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 14 - protein, 189 aa, Metridia pacifica
MGVKLIFAVVCVAAAQAATINENFEDIDLVAIGGSFALDVDANRGGHGGLPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 15 - DNA, 567 bp, Metridia pacifica; identical to SEQ ID NO: 13
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other

SEQ ID NO: 16 - protein, 189 aa, Metridia pacifica
MGVKLIFAVVCVAAAQAATINENFEDIDLVAIGGSFALDVDANRGGHGGLPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 17 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggnytnccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 18 - protein, 190 aa, Metridia longa
MGVKLIFAVVCVAVAQAATIQENFEDIDLVAIGGSFASDVDANRGGHGGLPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 19 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaarytnccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 20 - protein, 210 aa, Metridia pacifica
MMEIQVLFALICFALVQANPTENKDDIDIVGVEGKFGTTDLETDLFTIVEDMNVISRDTNLANSDADRGKLPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 21 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaarytnccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 22 - protein, 210 aa, Metridia pacifica
MMEIKVLFALICFALVQANPTENKDDIDIVGVEGKFGTTDLETDLFTIVEDMNVISRDTNLANSDADRGKLPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 23 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaarytnccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 24 - protein, 210 aa, Metridia pacifica
MMEVKVVFALICFALVQANPTENKDDIDIVGVEGKFGTTDLETDLFTIVEDMNVISRDTNLANSDADRGKLPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 25 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaarytnccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 26 - protein, 209 aa, Metridia longa
MDIKVLFALICIALVQANPTENNDHINIVGIEGKFGITDLETDLFTIWETNRMISTDNEQANTDSNRGKLPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 27 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaarytnccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 28 - protein, 169 aa, Metridia longa
MDIKFIFALVCIALVQANPTVNNDVNRGKLPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 29 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 30 - protein, 165 aa, Metridia longa
MKTDIADTDRASNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 31 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 32 - protein, 182 aa, Metridia longa
MDIKVVFTLVFSALVQAQKTDIADTDRASNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 33 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 34 - protein, 219 aa, Metridia longa
MDIKVVFTLVFSALVQAKSTEFDPNIDIVGLEGKFGITNLETDLFTIWETMEVMIKADIADTDRASNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 35 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 36 - protein, 219 aa, Metridia longa
MDIKVVFTLVFSALVQAKSTEFDPNIDIVGLEGKFGITNLETDLFTIWETMEVMIKADIADTDRASNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 37 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 38 - protein, 218 aa, Metridia longa
MDMKVIFALIFSALVQAKSTEFDPNIDIVGLEGKFGITNLETDLFTIWETMEVIKSDIADTDRVSNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 39 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 40 - protein, 218 aa, Metridia longa
MDIKVVFALVFSALVQAKSTEFDPNIDIVGLEGKFGITNLETDLFTIWETMEVIKTDIADTDRARSFVATETDANRGKLPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 41 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 42 - protein, 218 aa, Metridia longa
MDIKVVFALVFSALVQAKSTEFDPNIDVVGLEGKFGITNLETDLFTIWETMEVIKTDIADTDRARNFVATETDANRGKLPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 43 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 44 - protein, 218 aa, Metridia longa
MDMRVIFALVFSSLVQAKSTEFDPNINIVGLEGKFGITNLETDLFTIWETMDVIKSDITDTDRVSNFVATETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 45 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 46 - protein, 147 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 47 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 48 - protein, 151 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKDEL

SEQ ID NO: 49 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 50 - protein, 147 aa, Gaussia princeps
DLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 51 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 52 - protein, 147 aa, Gaussia princeps
DLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDLCVDCTTGCLKGLANVQCSDLLKKWLPQRCATFASKIQGQVDKIKGAGGD

SEQ ID NO: 53 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggnytnccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 54 - protein, 151 aa, Metridia pacifica
DVDANRGGHGGLPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 55 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggnytnccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 56 - protein, 151 aa, Metridia pacifica
DVDANRGGHGGLPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 57 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggnytnccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 58 - protein, 151 aa, Metridia pacifica
DVDANRGGHGGLPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 59 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggnytnccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 60 - protein, 152 aa, Metridia longa
DVDANRGGHGGLPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 61 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaarytnccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 62 - protein, 148 aa, Metridia pacifica
NSDADRGKLPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 63 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaarytnccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 64 - protein, 148 aa, Metridia longa
NTDSNRGKLPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 65 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaarytnccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 66 - protein, 148 aa, Metridia longa
NNDVNRGKLPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 67 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 68 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 69 - DNA, 444 bp, Metridia longa; identical to SEQ ID NO: 67
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 70 - protein, 148 aa, Metridia longa; identical to SEQ ID NO: 68

SEQ ID NO: 71 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 72 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 73 - DNA, 444 bp, Metridia longa; identical to SEQ ID NO: 71
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 74 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 75 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 76 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 77 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 78 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 79 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaarytnccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 80 - protein, 148 aa, Metridia longa
ETDANRGKLPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 81 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
gargcngargcngarmgnggnaarytnccnggnaaraarytnccnytngargtnytnathgaratggargcnaaygcnmgnaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccnaaymgntgygcnwsnttygcngayaarathcarwsngargtngayaayathaarggnytngcnggngaymgn

SEQ ID NO: 82 - protein, 148 aa, Metridia longa
EAEAERGKLPGKKLPLEVLIEMEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDR

SEQ ID NO: 83 - DNA, 51 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atgggngtnaargtnytnttygcnytnathtgyathgcngtngcngargcn

SEQ ID NO: 84 - protein, 17 aa, Gaussia princeps
MGVKVLFALICIAVAEA

SEQ ID NO: 85 - DNA, 51 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atgggngtnaarytnathttygcngtnytntgygtngcngcngcncargcn

SEQ ID NO: 86 - protein, 17 aa, Metridia pacifica
MGVKLIFAVLCVAAAQA

SEQ ID NO: 87 - DNA, 54 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
atgatggarathcargtnytnttygcnytnathtgyttygcnytngtncargcn

SEQ ID NO: 88 - protein, 18 aa, Metridia pacifica
MMEIQVLFALICFALVQA

SEQ ID NO: 89 - DNA, 54 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
atgatggarathaargtnytnttygcnytnathtgyttygcnytngtncargcn

SEQ ID NO: 90 - protein, 18 aa, Metridia pacifica
MMEIKVLFALICFALVQA

SEQ ID NO: 91 - DNA, 54 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
atgatggargtnaargtngtnttygcnytnathtgyttygcnytngtncargcn

SEQ ID NO: 92 - protein, 18 aa, Metridia pacifica
MMEVKVVFALICFALVQA

SEQ ID NO: 93 - DNA, 51 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayathaargtnytnttygcnytnathtgyathgcnytngtncargcn

SEQ ID NO: 94 - protein, 17 aa, Metridia longa
MDIKVLFALICIALVQA

SEQ ID NO: 95 - DNA, 51 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayathaarttyathttygcnytngtntgyathgcnytngtncargcn

SEQ ID NO: 96 - protein, 17 aa, Metridia longa
MDIKFIFALVCIALVQA

SEQ ID NO: 97 - DNA, 51 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayathaargtngtnttyacnytngtnttywsngcnytngtncargcn

SEQ ID NO: 98 - protein, 17 aa, Metridia longa
MDIKVVFTLVFSALVQA

SEQ ID NO: 99 - DNA, 51 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayatgaargtnathttygcnytnathttywsngcnytngtncargcn

SEQ ID NO: 100 - protein, 17 aa, Metridia longa
MDMKVIFALIFSALVQA

SEQ ID NO: 101 - DNA, 51 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayathaargtngtnttygcnytngtnttywsngcnytngtncargcn

SEQ ID NO: 102 - protein, 17 aa, Metridia longa
MDIKVVFALVFSALVQA

SEQ ID NO: 103 - DNA, 51 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
atggayatgmgngtnathttygcnytngtnttywsnwsnytngtncargcn

SEQ ID NO: 104 - protein, 17 aa, Metridia longa
MDMRVIFALVFSSLVQA

SEQ ID NO: 105 - DNA, 63 bp, Gaussia princeps
  modified_base (6)..(6): a, c, t, g, unknown or other
  modified_base (9)..(9): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
aarccnacngaraayaaygargayttyaayathgtngcngtngcnwsnaayttygcnacnacn

SEQ ID NO: 106 - protein, 21 aa, Gaussia princeps
KPTENNEDFNIVAVASNFATT

SEQ ID NO: 107 - DNA, 63 bp, Metridia pacifica
  modified_base (3)..(3): a, c, t, g, unknown or other
  modified_base (6)..(6): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
gcnacnathaaygaraayttygargayathgaygtngtngcnathggnggnwsnttygcnytn

SEQ ID NO: 108 - protein, 21 aa, Metridia pacifica
ATINENFEDIDVVAIGGSFAL

SEQ ID NO: 109 - DNA, 63 bp, Metridia pacifica
  modified_base (3)..(3): a, c, t, g, unknown or other
  modified_base (6)..(6): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
gcnacnathaaygaraayttygargayathgayytngtngcnathggnggnwsnttygcnytn

SEQ ID NO: 110 - protein, 21 aa, Metridia pacifica
ATINENFEDIDLVAIGGSFAL

SEQ ID NO: 111 - DNA, 63 bp, Metridia longa
  modified_base (3)..(3): a, c, t, g, unknown or other
  modified_base (6)..(6): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
gcnacnathcargaraayttygargayathgayytngtngcnathggnggnwsnttygcnwsn

SEQ ID NO: 112 - protein, 21 aa, Metridia longa
ATIQENFEDIDLVAIGGSFAS

SEQ ID NO: 113 - DNA, 132 bp, Metridia pacifica
  modified_base (6)..(6): a, c, t, g, unknown or other
  modified_base (9)..(9): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (108)..(108): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
aayccnacngaraayaargaygayathgayathgtnggngtngarggnaarttyggnacnacngayytngaracngayytnttyacnathgtngargayatgaaygtnathwsnmgngayacnaayytngcn

SEQ ID NO: 114 - protein, 44 aa, Metridia pacifica
NPTENKDDIDIVGVEGKFGTTDLETDLFTIVEDMNVISRDTNLA

SEQ ID NO: 115 - DNA, 132 bp, Metridia longa
  modified_base (6)..(6): a, c, t, g, unknown or other
  modified_base (9)..(9): a, c, t, g, unknown or other
  modified_base (36)..(36): a, c, t, g, unknown or other
  modified_base (39)..(39): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (132)..(132): a, c, t, g, unknown or other
aayccnacngaraayaaygaycayathaayathgtnggnathgarggnaarttyggnathacngayytngaracngayytnttyacnathtgggaracnaaymgnatgathwsnacngayaaygarcargcn

SEQ ID NO: 116 - protein, 44 aa, Metridia longa
NPTENNDHINIVGIEGKFGITDLETDLFTIWETNRMISTDNEQA

SEQ ID NO: 117 - DNA, 12 bp, Metridia longa
  modified_base (6)..(6): a, c, t, g, unknown or other
  modified_base (9)..(9): a, c, t, g, unknown or other
  modified_base (12)..(12): a, c, t, g, unknown or other
aayccnacngtn

SEQ ID NO: 118 - protein, 4 aa, Metridia longa
NPTV

SEQ ID NO: 119 - DNA, 48 bp, Metridia longa
  modified_base (6)..(6): a, c, t, g, unknown or other
  modified_base (15)..(15): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
aaracngayathgcngayacngaymgngcnwsnaayttygtngcnacn

SEQ ID NO: 120 - protein, 16 aa, Metridia longa
KTDIADTDRASNFVAT

SEQ ID NO: 121 - DNA, 51 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
caraaracngayathgcngayacngaymgngcnwsnaayttygtngcnacn

SEQ ID NO: 122 - protein, 17 aa, Metridia longa
QKTDIADTDRASNFVAT

SEQ ID NO: 123 - DNA, 162 bp, Metridia longa
  modified_base (6)..(6): a, c, t, g, unknown or other
  modified_base (9)..(9): a, c, t, g, unknown or other
  modified_base (21)..(21): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (108)..(108): a, c, t, g, unknown or other
  modified_base (120)..(120): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
aarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacn

SEQ ID NO: 124 - protein, 54 aa, Metridia longa
KSTEFDPNIDIVGLEGKFGITNLETDLFTIWETMEVMIKADIADTDRASNFVAT

SEQ ID NO: 125 - DNA, 159 bp, Metridia longa
  modified_base (6)..(6): a, c, t, g, unknown or other
  modified_base (9)..(9): a, c, t, g, unknown or other
  modified_base (21)..(21): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (108)..(108): a, c, t, g, unknown or other
  modified_base (117)..(117): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (141)..(141): a, c, t, g, unknown or other
  modified_base (144)..(144): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
aarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacn

SEQ ID NO: 126 - protein, 53 aa, Metridia longa
KSTEFDPNIDIVGLEGKFGITNLETDLFTIWETMEVIKSDIADTDRVSNFVAT

SEQ ID NO: 127 - DNA, 159 bp, Metridia longa
  modified_base (6)..(6): a, c, t, g, unknown or other
  modified_base (9)..(9): a, c, t, g, unknown or other
  modified_base (21)..(21): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (108)..(108): a, c, t, g, unknown or other
  modified_base (117)..(117): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
aarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacn

SEQ ID NO: 128 - protein, 53 aa, Metridia longa
KSTEFDPNIDIVGLEGKFGITNLETDLFTIWETMEVIKTDIADTDRARSFVAT

SEQ ID NO: 129 - DNA, 159 bp, Metridia longa
  modified_base (6)..(6): a, c, t, g, unknown or other
  modified_base (9)..(9): a, c, t, g, unknown or other
  modified_base (21)..(21): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (108)..(108): a, c, t, g, unknown or other
  modified_base (117)..(117): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (141)..(141): a, c, t, g, unknown or other
  modified_base (144)..(144): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
aarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacn

SEQ ID NO: 130 - protein, 53 aa, Metridia longa
KSTEFDPNIDVVGLEGKFGITNLETDLFTIWETMEVIKTDIADTDRARNFVAT

SEQ ID NO: 131 - DNA, 159 bp, Metridia longa
  modified_base (6)..(6): a, c, t, g, unknown or other
  modified_base (9)..(9): a, c, t, g, unknown or other
  modified_base (21)..(21): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (48)..(48): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (99)..(99): a, c, t, g, unknown or other
  modified_base (108)..(108): a, c, t, g, unknown or other
  modified_base (117)..(117): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (141)..(141): a, c, t, g, unknown or other
  modified_base (144)..(144): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
aarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacn

SEQ ID NO: 132 - protein, 53 aa, Metridia longa
KSTEFDPNINIVGLEGKFGITNLETDLFTIWETMDVIKSDITDTDRVSNFVAT

SEQ ID NO: 133 - skipped

SEQ ID NO: 134 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 135 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 136 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 137 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 138 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 139 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 140 - protein, 151 aa, Metridia pacifica
DVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 141 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 142 - protein, 152 aa, Metridia longa
DVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 143 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 144 - protein, 148 aa, Metridia pacifica
NSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 145 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 146 - protein, 148 aa, Metridia longa
NTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 147 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 148 - protein, 148 aa, Metridia longa
NNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 149 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 150 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 151 - DNA, 444 bp, Metridia longa; identical to SEQ ID NO: 149
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 152 - protein, 148 aa, Metridia longa; identical to SEQ ID NO: 150

SEQ ID NO: 153 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 154 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 155 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 156 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 157 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 158 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 159 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 160 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 161 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 162 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 163 - skipped

SEQ ID NO: 164 - protein, 148 aa, Metridia longa
EAEAERGKLPGKKMPLEVLIEMEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDR

SEQ ID NO: 165 - skipped

SEQ ID NO: 166 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 167 - skipped

SEQ ID NO: 168 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 169 - skipped

SEQ ID NO: 170 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 171 - skipped

SEQ ID NO: 172 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 173 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 174 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 175 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 176 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGDKDEL

SEQ ID NO: 177 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 178 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 179 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 180 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCADYEGDKESAQGGIGEAIVDIPEIPGFKDLEPLEQFIAQVDLCVDCTTGCLKGLANVQCSDLLKKWLPQRCATFASKIQGQVDKIKGAGGD

SEQ ID NO: 181 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (243)..(243): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 182 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 183 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 184 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 185 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 186 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 187 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 188 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 189 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 190 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 191 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 192 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 193 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 194 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 195 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 196 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 197 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (354)..(354): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 198 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 199 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 200 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 201 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 202 - protein, 165 aa, Metridia longa
MKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 203 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 204 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 205 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 206 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 207 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 208 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 209 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 210 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 211 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 212 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 213 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 214 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 215 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 216 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 217 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 218 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 219 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 220 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGDKDEL

SEQ ID NO: 221 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 222 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 223 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 224 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDRCADCTTGCLKGLANVQCSDLLKKWLPQRCATFASKIQGQVDKIKGAGGD

SEQ ID NO: 225 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 226 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 227 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 228 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSALLKKWLPSRCKTFASKIQSQVDTIKGLAGDR

SEQ ID NO: 229 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 230 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 231 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 232 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 233 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 234 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDRCADCTTGCLKGLANVHCSDLLKKWLPSRCKTFASKIQSQVDTIKGLAGDR

SEQ ID NO: 235 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 236 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 237 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 238 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 239 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 240 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 241 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 242 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCADCTTGCLKGLANVKCSELLKKWLPDRCASFADKIQSEVHNIKGLAGDR

SEQ ID NO: 243 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 244 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDRCADCTTGCLKGLANVKCSELLKKWLPDRCASFADKIQKEAHNIKGLAGDR

SEQ ID NO: 245 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 246 - protein, 165 aa, Metridia longa
MKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 247 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 248 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 249 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 250 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 251 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 252 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCADCTTGCLKGLANVKCSELLKKWLPDRCASFADKIQKEVHNIKGMAGDR

SEQ ID NO: 253 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 254 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 255 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 256 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCTTGCLKGLANVKCSELLKKWLPDRCASFADKIQKEVHNIKGMAGDR

SEQ ID NO: 257 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 258 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCNTGCLKGLANVKCSELLKKWLPDRCASFADKIQKEVHNIKGMAGDR

SEQ ID NO: 259 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 260 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPGRCASFADKIQKEVHNIKGMAGDR

SEQ ID NO: 261 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 262 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 263 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 264 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGDKDEL

SEQ ID NO: 265 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 266 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 267 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 268 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDLCVDCTTGCLKGLANVKCSDLLKKWLPQRCATFASKIQGQVDKIKGAGGD

SEQ ID NO: 269 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 270 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 271 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 272 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 273 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 274 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 275 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 276 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 277 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 278 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVKCSDLLKKWLPSRCKTFASKIQSQVDTIKGLAGDR

SEQ ID NO: 279 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 280 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 281 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 282 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 283 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 284 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 285 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 286 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSDLLKKWLPDRCASFADKIQSEVHNIKGLAGDR

SEQ ID NO: 287 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 288 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSDLLKKWLPDRCASFADKIQKEAHNIKGLAGDR

SEQ ID NO: 289 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 290 - protein, 165 aa, Metridia longa
MKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 291 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 292 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 293 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 294 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 295 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 296 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSDLLKKWLPDRCASFADKIQKEVHNIKGMAGDR

SEQ ID NO: 297 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 298 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSDLLKKWLPDRCASFADKIQKEVHNIKGMAGDR

SEQ ID NO: 299 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 300 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSDLLKKWLPDRCASFADKIQKEVHNIKGMAGDR

SEQ ID NO: 301 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 302 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSDLLKKWLPDRCASFADKIQKEVHNIKGMAGDR

SEQ ID NO: 303 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 304 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSDLLKKWLPGRCASFADKIQKEVHNIKGMAGDR

SEQ ID NO: 305 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 306 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 307 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 308 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGDKDEL

SEQ ID NO: 309 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 310 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 311 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 312 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCADYEGDKESAQGGIGEAIVDIPEIPGFKDLEPLEQFIAQVDRCADCTTGCLKGLANVQCSDLLKKWLPQRCATFASKIQGQVDKIKGAGGD

SEQ ID NO: 313 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (243)..(243): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 314 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 315 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 316 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSALLKKWLPSRCKTFASKIQSQVDTIKGLAGDR

SEQ ID NO: 317 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 318 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 319 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 320 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 321 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 322 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDRCADCTTGCLKGLANVHCSDLLKKWLPSRCKTFASKIQSQVDTIKGLAGDR

SEQ ID NO: 323 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 324 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 325 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 326 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 327 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 328 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 329 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (354)..(354): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 330 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCADCTTGCLKGLANVKCSELLKKWLPDRCASFADKIQSEVHNIKGLAGDR

SEQ ID NO: 331 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 332 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDRCADCTTGCLKGLANVKCSELLKKWLPDRCASFADKIQKEAHNIKGLAGDR

SEQ ID NO: 333 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 334 - protein, 165 aa, Metridia longa
MKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 335 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 336 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 337 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 338 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 339 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 340 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCADCTTGCLKGLANVKCSELLKKWLPDRCASFADKIQKEVHNIKGMAGDR

SEQ ID NO: 341 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 342 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 343 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 344 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCTTGCLKGLANVKCSELLKKWLPDRCASFADKIQKEVHNIKGMAGDR

SEQ ID NO: 345 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 346 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCNTGCLKGLANVKCSELLKKWLPDRCASFADKIQKEVHNIKGMAGDR

SEQ ID NO: 347 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 348 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPGRCASFADKIQKEVHNIKGMAGDR

SEQ ID NO: 349 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 350 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 351 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 352 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGDKDEL

SEQ ID NO: 353 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 354 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 355 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 356 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCADYEGDKESAQGGIGEAIVDIPEIPGFKDLEPLEQFIAQVDLCVDCTTGCLKGLANVKCSDLLKKWLPQRCATFASKIQGQVDKIKGAGGD

SEQ ID NO: 357 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (243)..(243): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 358 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 359 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 360 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 361 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 362 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 363 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 364 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 365 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 366 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDLCEDCTTGCLKGLANVKCSDLLKKWLPSRCKTFASKIQSQVDTIKGLAGDR

SEQ ID NO: 367 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 368 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 369 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 370 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 371 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 372 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 373 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (354)..(354): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 374 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCTDCTTGCLKGLANVKCSDLLKKWLPDRCASFADKIQSEVHNIKGLAGDR

SEQ ID NO: 375 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 376 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDLCADCTTGCLKGLANVKCSDLLKKWLPDRCASFADKIQKEAHNIKGLAGDR

SEQ ID NO: 377 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 378 - protein, 165 aa, Metridia longa
MKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 379 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 380 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 381 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 382 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 383 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 384 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCASCTTGCLKGLANVKCSDLLKKWLPDRCASFADKIQKEVHNIKGMAGDR

SEQ ID NO: 385 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 386 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCTSCTTGCLKGLANVKCSDLLKKWLPDRCASFADKIQKEVHNIKGMAGDR

SEQ ID NO: 387 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 388 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCTTGCLKGLANVKCSDLLKKWLPDRCASFADKIQKEVHNIKGMAGDR

SEQ ID NO: 389 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 390 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCNTGCLKGLANVKCSDLLKKWLPDRCASFADKIQKEVHNIKGMAGDR

SEQ ID NO: 391 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 392 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDLCATCTTGCLKGLANVKCSDLLKKWLPGRCASFADKIQKEVHNIKGMAGDR

SEQ ID NO: 393 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 394 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 395 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 396 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGDKDEL

SEQ ID NO: 397 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 398 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 399 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 400 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDRCADCTTGCLKGLANVKCSDLLKKWLPQRCATFASKIQGQVDKIKGAGGD

SEQ ID NO: 401 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 402 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 403 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 404 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 405 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 406 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 407 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 408 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 409 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 410 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDRCADCTTGCLKGLANVKCSDLLKKWLPSRCKTFASKIQSQVDTIKGLAGDR

SEQ ID NO: 411 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 412 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 413 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 414 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 415 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 416 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 417 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 418 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCADCTTGCLKGLANVKCSDLLKKWLPDRCASFADKIQSEVHNIKGLAGDR

SEQ ID NO: 419 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 420 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDRCADCTTGCLKGLANVKCSDLLKKWLPDRCASFADKIQKEAHNIKGLAGDR

SEQ ID NO: 421 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 422 - protein, 165 aa, Metridia longa
MKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 423 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 424 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 425 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 426 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 427 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 428 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCADCTTGCLKGLANVKCSDLLKKWLPDRCASFADKIQKEVHNIKGMAGDR

SEQ ID NO: 429 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 430 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 431 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 432 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCTTGCLKGLANVKCSDLLKKWLPDRCASFADKIQKEVHNIKGMAGDR

SEQ ID NO: 433 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 434 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCNTGCLKGLANVKCSDLLKKWLPDRCASFADKIQKEVHNIKGMAGDR

SEQ ID NO: 435 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 436 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPGRCASFADKIQKEVHNIKGMAGDR

SEQ ID NO: 437 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 438 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 439 - DNA, 567 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (567)..(567): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 440 - protein, 189 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGDKDEL

SEQ ID NO: 441 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 442 - protein, 185 aa, Gaussia princeps
MGVKVLFALICIAVAEAKPTENNEDFNIVAVASNFATTDLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 443 - DNA, 555 bp, Gaussia princeps
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (249)..(249): a, c, t, g, unknown or other
  modified_base (252)..(252): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (462)..(462): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (528)..(528): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
atgggngtnaargtnytnttygcnytnathtgyathgcngtngcngargcnaarccnacngaraayaaygargayttyaayathgtngcngtngcnwsnaayttygcnacnacngayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 444 - protein, 185 aa, Gaussia princeps
MGVKVLFALICIAVAEAKPTENNEDFNIVAVASNFATTDLDADRGKLPGKKLPLEVLKELEANARKAGCTRGCLICLSHIKCTPKMKKFIPGRCADYEGDKESAQGGIGEAIVDIPEIPGFKDLEPLEQFIAQVDRCADCTTGCLKGLANVKCSDLLKKWLPQRCATFASKIQGQVDKIKGAGGD

SEQ ID NO: 445 - DNA, 513 bp, Gaussia princeps
  modified_base (9)..(9): a, c, t, g, unknown or other
  modified_base (15)..(15): a, c, t, g, unknown or other
  modified_base (18)..(18): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (207)..(207): a, c, t, g, unknown or other
  modified_base (210)..(210): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (243)..(243): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
atggargcnaarccnacngaraayaaygargayttyaayathgtngcngtngcnwsnaayttygcnacnacngayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 446 - protein, 171 aa, Gaussia princeps
MEAKPTENNEDFNIVAVASNFATTDLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 447 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtnytntgygtngcngcngcncargcngcnacnathaaygaraayttygargayathgaygtngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 448 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 449 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 450 - protein, 189 aa, Metridia pacifica
MGVKLIFAVVCVAAAQAATINENFEDIDLVAIGGSFALDVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 451 - DNA, 567 bp, Metridia pacifica
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (348)..(348): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (417)..(417): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (519)..(519): a, c, t, g, unknown or other
  modified_base (531)..(531): a, c, t, g, unknown or other
  modified_base (537)..(537): a, c, t, g, unknown or other
  modified_base (543)..(543): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
atgggngtnaarytnathttygcngtngtntgygtngcngcngcncargcngcnacnathaaygaraayttygargayathgayytngtngcnathggnggnwsnttygcnytngaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 452 - protein, 189 aa, Metridia pacifica
MGVKLIFAVVCVAAAQAATINENFEDIDLVAIGGSFALDVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 453 - DNA, 570 bp, Metridia longa
  modified_base (6)..(6): a, c, t, g, unknown or other
  modified_base (9)..(9): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (390)..(390): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
atgggngtnaarytnathttygcngtngtntgygtngcngtngcncargcngcnacnathcargaraayttygargayathgayytngtngcnathggnggnwsnttygcnwsngaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 454 - protein, 190 aa, Metridia longa
MGVKLIFAVVCVAVAQAATIQENFEDIDLVAIGGSFASDVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDRCADCTTGCLKGLANVKCSDLLKKWLPSRCKTFASKIQSQVDTIKGLAGDR

SEQ ID NO: 455 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathcargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 456 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 457 - DNA, 630 bp, Metridia pacifica
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggarathaargtnytnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 458 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 459 - DNA, 630 bp, Metridia pacifica
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (141)..(141): a, c, t, g, unknown or other
  modified_base (147)..(147): a, c, t, g, unknown or other
  modified_base (162)..(162): a, c, t, g, unknown or other
  modified_base (168)..(168): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (216)..(216): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (468)..(468): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (594)..(594): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
atgatggargtnaargtngtnttygcnytnathtgyttygcnytngtncargcnaayccnacngaraayaargaygayathgayathgtnggngtngarggnaarttyggnacnacngayytngaracngayytnttyacnathgtngargayatgaaygtnathwsnmgngayacnaayytngcnaaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 460 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 461 - DNA, 627 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (87)..(87): a, c, t, g, unknown or other
  modified_base (90)..(90): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (156)..(156): a, c, t, g, unknown or other
  modified_base (165)..(165): a, c, t, g, unknown or other
  modified_base (168)..(168): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (354)..(354): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (444)..(444): a, c, t, g, unknown or other
  modified_base (447)..(447): a, c, t, g, unknown or other
  modified_base (465)..(465): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (591)..(591): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
atggayathaargtnytnttygcnytnathtgyathgcnytngtncargcnaayccnacngaraayaaygaycayathaayathgtnggnathgarggnaarttyggnathacngayytngaracngayytnttyacnathtgggaracnaaymgnatgathwsnacngayaaygarcargcnaayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 462 - protein, 209 aa, Metridia longa
MDIKVLFALICIALVQANPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCADCTTGCLKGLANVKCSDLLKKWLPDRCASFADKIQSEVHNIKGLAGDR

SEQ ID NO: 463 - DNA, 507 bp, Metridia longa
  modified_base (24)..(24): a, c, t, g, unknown or other
  modified_base (27)..(27): a, c, t, g, unknown or other
  modified_base (30)..(30): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (198)..(198): a, c, t, g, unknown or other
  modified_base (201)..(201): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
atggayathaarttyathttygcnytngtntgyathgcnytngtncargcnaayccnacngtnaayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 464 - protein, 169 aa, Metridia longa
MDIKFIFALVCIALVQANPTVNNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDRCADCTTGCLKGLANVKCSDLLKKWLPDRCASFADKIQKEAHNIKGLAGDR

SEQ ID NO: 465 - DNA, 495 bp, Metridia longa
  modified_base (9)..(9): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (159)..(159): a, c, t, g, unknown or other
  modified_base (168)..(168): a, c, t, g, unknown or other
  modified_base (171)..(171): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (297)..(297): a, c, t, g, unknown or other
  modified_base (312)..(312): a, c, t, g, unknown or other
  modified_base (315)..(315): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
atgaaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 466 - protein, 165 aa, Metridia longa
MKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 467 - DNA, 546 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (60)..(60): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (132)..(132): a, c, t, g, unknown or other
  modified_base (135)..(135): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (240)..(240): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (348)..(348): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (516)..(516): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
atggayathaargtngtnttyacnytngtnttywsngcnytngtncargcncaraaracngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 468 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 469 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 470 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 471 - DNA, 657 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (171)..(171): a, c, t, g, unknown or other
  modified_base (180)..(180): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (285)..(285): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
  modified_base (333)..(333): a, c, t, g, unknown or other
  modified_base (348)..(348): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (447)..(447): a, c, t, g, unknown or other
  modified_base (456)..(456): a, c, t, g, unknown or other
  modified_base (459)..(459): a, c, t, g, unknown or other
  modified_base (474)..(474): a, c, t, g, unknown or other
  modified_base (477)..(477): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (552)..(552): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (582)..(582): a, c, t, g, unknown or other
  modified_base (585)..(585): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
atggayathaargtngtnttyacnytngtnttywsngcnytngtncargcnaarwsnacngarttygayccnaayathgayathgtnggnytngarggnaarttyggnathacnaayytngaracngayytnttyacnathtgggaracnatggargtnatgathaargcngayathgcngayacngaymgngcnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 472 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCADCTTGCLKGLANVKCSDLLKKWLPDRCASFADKIQKEVHNIKGMAGDR

SEQ ID NO: 473 - DNA, 654 bp, Metridia longa
  modified_base (15)..(15): a, c, t, g, unknown or other
  modified_base (24)..(24): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgaargtnathttygcnytnathttywsngcnytngtncargcnaarwsnacngarttygayccnaayathgayathgtnggnytngarggnaarttyggnathacnaayytngaracngayytnttyacnathtgggaracnatggargtnathaarwsngayathgcngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 474 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 475 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgayathgtnggnytngarggnaarttyggnathacnaayytngaracngayytnttyacnathtgggaracnatggargtnathaaracngayathgcngayacngaymgngcnmgnwsnttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 476 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCTTGCLKGLANVKCSDLLKKWLPDRCASFADKIQKEVHNIKGMAGDR

SEQ ID NO: 477 - DNA, 654 bp, Metridia longa
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayathaargtngtnttygcnytngtnttywsngcnytngtncargcnaarwsnacngarttygayccnaayathgaygtngtnggnytngarggnaarttyggnathacnaayytngaracngayytnttyacnathtgggaracnatggargtnathaaracngayathgcngayacngaymgngcnmgnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 478 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCNTGCLKGLANVKCSDLLKKWLPDRCASFADKIQKEVHNIKGMAGDR

SEQ ID NO: 479 - DNA, 654 bp, Metridia longa
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (216)..(216): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (240)..(240): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (348)..(348): a, c, t, g, unknown or other
  modified_base (360)..(360): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (435)..(435): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (624)..(624): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
atggayatgmgngtnathttygcnytngtnttywsnwsnytngtncargcnaarwsnacngarttygayccnaayathaayathgtnggnytngarggnaarttyggnathacnaayytngaracngayytnttyacnathtgggaracnatggaygtnathaarwsngayathacngayacngaymgngtnwsnaayttygtngcnacngaracngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 480 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPGRCASFADKIQKEVHNIKGMAGDR

SEQ ID NO: 481 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 482 - protein, 147 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 483 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 484 - protein, 151 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGDKDEL

SEQ ID NO: 485 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 486 - protein, 147 aa, Gaussia princeps
DLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 487 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 488 - protein, 147 aa, Gaussia princeps
DLDADRGKLPGKKLPLEVLKELEANARKAGCTRGCLICLSHIKCTPKMKKFIPGRCADYEGDKESAQGGIGEAIVDIPEIPGFKDLEPLEQFIAQVDLCVDCTTGCLKGLANVQCSDLLKKWLPQRCATFASKIQGQVDKIKGAGGD

SEQ ID NO: 489 - DNA, 441 bp, Gaussia princeps; identical to SEQ ID NO: 481
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 490 - protein, 147 aa, Gaussia princeps; identical to SEQ ID NO: 482

SEQ ID NO: 491 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 492 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 493 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 494 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 495 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 496 - protein, 151 aa, Metridia pacifica
DVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVHCSDLLKKWLPSRCKTFASKIQSQVDTIKGLAGDR

SEQ ID NO: 497 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 498 - protein, 152 aa, Metridia longa
DVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDLCEDCTTGCLKGLANVHCSDLLKKWLPSRCKTFASKIQSQVDTIKGLAGDR

SEQ ID NO: 499 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 500 - protein, 148 aa, Metridia pacifica
NSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 501 - DNA, 444 bp, Metridia pacifica; identical to SEQ ID NO: 499
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 502 - protein, 148 aa, Metridia pacifica; identical to SEQ ID NO: 500

SEQ ID NO: 503 - DNA, 444 bp, Metridia pacifica; identical to SEQ ID NO: 499
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 504 - protein, 148 aa, Metridia pacifica; identical to SEQ ID NO: 500

SEQ ID NO: 505 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 506 - protein, 148 aa, Metridia longa
NTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 507 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 508 - protein, 148 aa, Metridia longa
NNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDLCADCTTGCLKGLANVKCSELLKKWLPDRCASFADKIQKEAHNIKGLAGDR

SEQ ID NO: 509 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 510 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 511 - DNA, 444 bp, Metridia longa; identical to SEQ ID NO: 509
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 512 - protein, 148 aa, Metridia longa; identical to SEQ ID NO: 510

SEQ ID NO: 513 - DNA, 444 bp, Metridia longa; identical to SEQ ID NO: 509
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 514 - protein, 148 aa, Metridia longa; identical to SEQ ID NO: 510

SEQ ID NO: 515 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 516 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 517 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 518 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 519 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 520 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 521 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 522 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 523 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 524 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 525 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 526 - protein, 147 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 527 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 528 - protein, 151 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGDKDEL

SEQ ID NO: 529 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 530 - protein, 147 aa, Gaussia princeps
DLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 531 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 532 - protein, 147 aa, Gaussia princeps
DLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDRCADCTTGCLKGLANVQCSDLLKKWLPQRCATFASKIQGQVDKIKGAGGD

SEQ ID NO: 533 - DNA, 441 bp, Gaussia princeps; identical to SEQ ID NO: 525
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 534 - protein, 147 aa, Gaussia princeps; identical to SEQ ID NO: 526

SEQ ID NO: 535 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 536 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSALLKKWLPSRCKTFASKIQSQVDTIKGLAGDR

SEQ ID NO: 537 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 538 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 539 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 540 - protein, 151 aa, Metridia pacifica
DVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 541 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 542 - protein, 152 aa, Metridia longa
DVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDRCADCTTGCLKGLANVHCSDLLKKWLPSRCKTFASKIQSQVDTIKGLAGDR

SEQ ID NO: 543 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 544 - protein, 148 aa, Metridia pacifica
NSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 545 - DNA, 444 bp, Metridia pacifica; identical to SEQ ID NO: 543
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 546 - protein, 148 aa, Metridia pacifica; identical to SEQ ID NO: 544

SEQ ID NO: 547 - DNA, 444 bp, Metridia pacifica; identical to SEQ ID NO: 543
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 548 - protein, 148 aa, Metridia pacifica; identical to SEQ ID NO: 544

SEQ ID NO: 549 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 550 - protein, 148 aa, Metridia longa
NTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCADCTTGCLKGLANVKCSELLKKWLPDRCASFADKIQSEVHNIKGLAGDR

SEQ ID NO: 551 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 552 - protein, 148 aa, Metridia longa
NNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDRCADCTTGCLKGLANVKCSELLKKWLPDRCASFADKIQKEAHNIKGLAGDR

SEQ ID NO: 553 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 554 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 555 - DNA, 444 bp, Metridia longa; identical to SEQ ID NO: 553
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 556 - protein, 148 aa, Metridia longa; identical to SEQ ID NO: 554

SEQ ID NO: 557 - DNA, 444 bp, Metridia longa; identical to SEQ ID NO: 553
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 558 - protein, 148 aa, Metridia longa; identical to SEQ ID NO: 554

SEQ ID NO: 559 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 560 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCADCTTGCLKGLANVKCSELLKKWLPDRCASFADKIQKEVHNIKGMAGDR

SEQ ID NO: 561 - DNA, 444 bp, Metridia longa; identical to SEQ ID NO: 553
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 562 - protein, 148 aa, Metridia longa; identical to SEQ ID NO: 554

SEQ ID NO: 563 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 564 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCTTGCLKGLANVKCSELLKKWLPDRCASFADKIQKEVHNIKGMAGDR

SEQ ID NO: 565 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 566 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCNTGCLKGLANVKCSELLKKWLPDRCASFADKIQKEVHNIKGMAGDR

SEQ ID NO: 567 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 568 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSELLKKWLPGRCASFADKIQKEVHNIKGMAGDR

SEQ ID NO: 569 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 570 - protein, 147 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 571 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 572 - protein, 151 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGDKDEL

SEQ ID NO: 573 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 574 - protein, 147 aa, Gaussia princeps
DLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 575 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 576 - protein, 147 aa, Gaussia princeps
DLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDLCVDCTTGCLKGLANVKCSDLLKKWLPQRCATFASKIQGQVDKIKGAGGD

SEQ ID NO: 577 - DNA, 441 bp, Gaussia princeps; identical to SEQ ID NO: 569
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 578 - protein, 147 aa, Gaussia princeps; identical to SEQ ID NO: 570

SEQ ID NO: 579 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 580 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 581 - DNA, 453 bp, Metridia pacifica; identical to SEQ ID NO: 579
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other

SEQ ID NO: 582 - protein, 151 aa, Metridia pacifica; identical to SEQ ID NO: 580

SEQ ID NO: 583 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 584 - protein, 151 aa, Metridia pacifica
DVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 585 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 586 - protein, 152 aa, Metridia longa
DVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDLCEDCTTGCLKGLANVKCSDLLKKWLPSRCKTFASKIQSQVDTIKGLAGDR

SEQ ID NO: 587 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 588 - protein, 148 aa, Metridia pacifica
NSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 589 - DNA, 444 bp, Metridia pacifica; identical to SEQ ID NO: 587
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 590 - protein, 148 aa, Metridia pacifica; identical to SEQ ID NO: 588

SEQ ID NO: 591 - DNA, 444 bp, Metridia pacifica; identical to SEQ ID NO: 587
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 592 - protein, 148 aa, Metridia pacifica; identical to SEQ ID NO: 588

SEQ ID NO: 593 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 594 - protein, 148 aa, Metridia longa
NTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSDLLKKWLPDRCASFADKIQSEVHNIKGLAGDR

SEQ ID NO: 595 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 596 - protein, 148 aa, Metridia longa
NNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDLCADCTTGCLKGLANVKCSDLLKKWLPDRCASFADKIQKEAHNIKGLAGDR

SEQ ID NO: 597 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 598 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 599 - DNA, 444 bp, Metridia longa; identical to SEQ ID NO: 597
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 600 - protein, 148 aa, Metridia longa; identical to SEQ ID NO: 598

SEQ ID NO: 601 - DNA, 444 bp, Metridia longa; identical to SEQ ID NO: 597
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 602 - protein, 148 aa, Metridia longa; identical to SEQ ID NO: 598

SEQ ID NO: 603 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 604 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSDLLKKWLPDRCASFADKIQKEVHNIKGMAGDR

SEQ ID NO: 605 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 606 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSDLLKKWLPDRCASFADKIQKEVHNIKGMAGDR

SEQ ID NO: 607 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 608 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSDLLKKWLPDRCASFADKIQKEVHNIKGMAGDR

SEQ ID NO: 609 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 610 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSDLLKKWLPDRCASFADKIQKEVHNIKGMAGDR

SEQ ID NO: 611 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 612 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSDLLKKWLPGRCASFADKIQKEVHNIKGMAGDR

SEQ ID NO: 613 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 614 - protein, 147 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 615 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngayaargaygarytn

SEQ ID NO: 616 - protein, 151 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGDKDEL

SEQ ID NO: 617 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 618 - protein, 147 aa, Gaussia princeps
DLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDRCADCTTGCLKGLANVQCSDLLKKWLPQRCATFASKIQGQVDKIKGAGGD

SEQ ID NO: 619 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtncartgywsngayytnytnaaraartggytnccncarmgntgygcnacnttygcnwsnaarathcarggncargtngayaarathaarggngcnggnggngay

SEQ ID NO: 620 - protein, 147 aa, Gaussia princeps
DLDADRGKLPGKKLPLEVLKELEANARKAGCTRGCLICLSHIKCTPKMKKFIPGRCADYEGDKESAQGGIGEAIVDIPEIPGFKDLEPLEQFIAQVDRCADCTTGCLKGLANVQCSDLLKKWLPQRCATFASKIQGQVDKIKGAGGD

SEQ ID NO: 621 - DNA, 441 bp, Gaussia princeps; identical to SEQ ID NO: 613
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 622 - protein, 147 aa, Gaussia princeps; identical to SEQ ID NO: 614

SEQ ID NO: 623 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngcnytnytnaaraartggytnccnwsnmgntgyaaracnttygcnwsnaarathcarwsncargtngayacnathaarggnytngcnggngaymgn

SEQ ID NO: 624 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSALLKKWLPSRCKTFASKIQSQVDTIKGLAGDR

SEQ ID NO: 625 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 626 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 627 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 628 - protein, 151 aa, Metridia pacifica
DVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDRCADCTTGCLKGLANVHCSDLLKKWLPSRCKTFASKIQSQVDTIKGLAGDR

SEQ ID NO: 629 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtncaytgywsngayytnytnaaraartggytnccnwsnmgntgyaaracnttygcnwsnaarathcarwsncargtngayacnathaarggnytngcnggngaymgn

SEQ ID NO: 630 - protein, 152 aa, Metridia longa
DVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDRCADCTTGCLKGLANVHCSDLLKKWLPSRCKTFASKIQSQVDTIKGLAGDR

SEQ ID NO: 631 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngcnytnytnaaraartggytnccngaymgntgygcnwsnttygcngayaarathcarwsngargtngayaayathaarggnytngcnggngaymgn

SEQ ID NO: 632 - protein, 148 aa, Metridia pacifica
NSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSALLKKWLPDRCASFADKIQSEVDNIKGLAGDR

SEQ ID NO: 633 - DNA, 444 bp, Metridia pacifica; identical to SEQ ID NO: 631
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 634 - protein, 148 aa, Metridia pacifica; identical to SEQ ID NO: 632

SEQ ID NO: 635 - DNA, 444 bp, Metridia pacifica; identical to SEQ ID NO: 631
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 636 - protein, 148 aa, Metridia pacifica; identical to SEQ ID NO: 632

SEQ ID NO: 637 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcarwsngargtncayaayathaarggnytngcnggngaymgn

SEQ ID NO: 638 - protein, 148 aa, Metridia longa
NTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCADCTTGCLKGLANVKCSELLKKWLPDRCASFADKIQSEVHNIKGLAGDR

SEQ ID NO: 639 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargcncayaayathaarggnytngcnggngaymgn

SEQ ID NO: 640 - protein, 148 aa, Metridia longa
NNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDRCADCTTGCLKGLANVKCSELLKKWLPDRCASFADKIQKEAHNIKGLAGDR

SEQ ID NO: 641 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 642 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPDRCASFADKIQKEVHNIKGMAGDR

SEQ ID NO: 643 - DNA, 444 bp, Metridia longa; identical to SEQ ID NO: 641
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 644 - protein, 148 aa, Metridia longa; identical to SEQ ID NO: 642

SEQ ID NO: 645 - DNA, 444 bp, Metridia longa; identical to SEQ ID NO: 641
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 646 - protein, 148 aa, Metridia longa; identical to SEQ ID NO: 642

SEQ ID NO: 647 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 648 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCADCTTGCLKGLANVKCSELLKKWLPDRCASFADKIQKEVHNIKGMAGDR

SEQ ID NO: 649 - DNA, 444 bp, Metridia longa; identical to SEQ ID NO: 641
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 650 - protein, 148 aa, Metridia longa; identical to SEQ ID NO: 642

SEQ ID NO: 651 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 652 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCTTGCLKGLANVKCSELLKKWLPDRCASFADKIQKEVHNIKGMAGDR

SEQ ID NO: 653 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngarytnytnaaraartggytnccngaymgntgygcnwsnttygcngayaarathcaraargargtncayaayathaarggnatggcnggngaymgn

SEQ ID NO: 654 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCNTGCLKGLANVKCSELLKKWLPDRCASFADKIQKEVHNIKGMAGDR

SEQ ID NO: 655 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngarytnytnaaraartggytnccnggnmgntgygcnwsnttygcngayaarathcaraargargtncayaayathaarggnatggcnggngaymgn

SEQ ID NO: 656 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSELLKKWLPGRCASFADKIQKEVHNIKGMAGDR

SEQ ID NO: 657 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 658 - protein, 147 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 659 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 660 - protein, 151 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGDKDEL

SEQ ID NO: 661 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 662 - protein, 147 aa, Gaussia princeps
DLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDLCVDCTTGCLKGLANVKCSDLLKKWLPQRCATFASKIQGQVDKIKGAGGD

SEQ ID NO: 663 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngayytntgygtngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 664 - protein, 147 aa, Gaussia princeps
DLDADRGKLPGKKLPLEVLKELEANARKAGCTRGCLICLSHIKCTPKMKKFIPGRCADYEGDKESAQGGIGEAIVDIPEIPGFKDLEPLEQFIAQVDLCVDCTTGCLKGLANVKCSDLLKKWLPQRCATFASKIQGQVDKIKGAGGD

SEQ ID NO: 665 - DNA, 441 bp, Gaussia princeps; identical to SEQ ID NO: 657
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 666 - protein, 147 aa, Gaussia princeps; identical to SEQ ID NO: 658

SEQ ID NO: 667 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 668 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 669 - DNA, 453 bp, Metridia pacifica; identical to SEQ ID NO: 667
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other

SEQ ID NO: 670 - protein, 151 aa, Metridia pacifica; identical to SEQ ID NO: 668

SEQ ID NO: 671 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngayytntgygtngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 672 - protein, 151 aa, Metridia pacifica
DVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDLCVDCTTGCLKGLANVKCSDLLKKWLPSRCKTFASKIQSQVDTIKGLAGDR

SEQ ID NO: 673 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngayytntgygargaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 674 - protein, 152 aa, Metridia longa
DVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDLCEDCTTGCLKGLANVKCSDLLKKWLPSRCKTFASKIQSQVDTIKGLAGDR

SEQ ID NO: 675 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 676 - protein, 148 aa, Metridia pacifica
NSDADRGKMPGKKLPLEVLIEMEANARKAGCTRGCLICLSKIKCTAKMKVYIPGRCADYGGDKKTGQAGIVGAIVDIPEISGFKELGPMEQFIAQVDLCADCTTGCLKGLANVKCSDLLKKWLPDRCASFADKIQSEVDNIKGLAGDR

SEQ ID NO: 677 - DNA, 444 bp, Metridia pacifica; identical to SEQ ID NO: 675
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 678 - protein, 148 aa, Metridia pacifica; identical to SEQ ID NO: 676

SEQ ID NO: 679 - DNA, 444 bp, Metridia pacifica; identical to SEQ ID NO: 675
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 680 - protein, 148 aa, Metridia pacifica; identical to SEQ ID NO: 676

SEQ ID NO: 681 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgyacngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 682 - protein, 148 aa, Metridia longa
NTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCTDCTTGCLKGLANVKCSDLLKKWLPDRCASFADKIQSEVHNIKGLAGDR

SEQ ID NO: 683 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngayytntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 684 - protein, 148 aa, Metridia longa
NNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDLCADCTTGCLKGLANVKCSDLLKKWLPDRCASFADKIQKEAHNIKGLAGDR

SEQ ID NO: 685 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 686 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCASCTTGCLKGLANVKCSDLLKKWLPDRCASFADKIQKEVHNIKGMAGDR

SEQ ID NO: 687 - DNA, 444 bp, Metridia longa; identical to SEQ ID NO: 685
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 688 - protein, 148 aa, Metridia longa; identical to SEQ ID NO: 686

SEQ ID NO: 689 - DNA, 444 bp, Metridia longa; identical to SEQ ID NO: 685
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 690 - protein, 148 aa, Metridia longa; identical to SEQ ID NO: 686

SEQ ID NO: 691 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 692 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCASCTTGCLKGLANVKCSDLLKKWLPDRCASFADKIQKEVHNIKGMAGDR

SEQ ID NO: 693 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgyacnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 694 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCTSCTTGCLKGLANVKCSDLLKKWLPDRCASFADKIQKEVHNIKGMAGDR

SEQ ID NO: 695 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 696 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCTTGCLKGLANVKCSDLLKKWLPDRCASFADKIQKEVHNIKGMAGDR

SEQ ID NO: 697 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcnwsntgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 698 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCASCNTGCLKGLANVKCSDLLKKWLPDRCASFADKIQKEVHNIKGMAGDR

SEQ ID NO: 699 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngayytntgygcnacntgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 700 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDLCATCTTGCLKGLANVKCSDLLKKWLPGRCASFADKIQKEVHNIKGMAGDR

SEQ ID NO: 701 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 702 - protein, 147 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 703 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 704 - protein, 151 aa, Gaussia princeps
DLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGDKDEL

SEQ ID NO: 705 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 706 - protein, 147 aa, Gaussia princeps
DLDADRGKLPGKKLPLEVLKEIEANARKAGCTRGCLICLSHIKCTPKMKKFIPGRCHTYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 707 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgycayacntaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 708 - protein, 147 aa, Gaussia princeps
DLDADRGKLPGKKLPLEVLKELEANARKAGCTRGCLICLSHIKCTPKMKKFIPGRCHTYEGDKESAQGGIGEAIVDIPEIPGFKDLEPLEQFIAQVDRCADCTTGCLKGLANVKCSDLLKKWLPQRCATFASKIQGQVDKIKGAGGD

SEQ ID NO: 709 - DNA, 441 bp, Gaussia princeps; identical to SEQ ID NO: 701
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (174)..(174): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 710 - protein, 147 aa, Gaussia princeps; identical to SEQ ID NO: 702

SEQ ID NO: 711 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 712 - protein, 151 aa, Metridia pacifica
DVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 713 - DNA, 453 bp, Metridia pacifica; identical to SEQ ID NO: 711
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other

SEQ ID NO: 714 - protein, 151 aa, Metridia pacifica; identical to SEQ ID NO: 712

SEQ ID NO: 715 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgycaywsntaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 716 - protein, 151 aa, Metridia pacifica
DVDANRGGHGGHPGKKMPKEVPVEMEANAKRAGCHRGCLICLSHIKCTKKMKKFIPGRCHSYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 717 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgycaywsntaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 718 - protein, 152 aa, Metridia longa
DVDANRGGHGGHPGKKMPKEVLMEMEANAKRAGCHRGCLVCLSHIKCTAQMQKFIPGRCHSYAGDKDSAQGGIAGGAIVDIPEIAGFKEMKPMEQFIAQVDRCADCTTGCLKGLANVKCSDLLKKWLPSRCKTFASKIQSQVDTIKGLAGDR

SEQ ID NO: 719 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 720 - protein, 148 aa, Metridia pacifica
NSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 721 - DNA, 444 bp, Metridia pacifica; identical to SEQ ID NO: 719
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 722 - protein, 148 aa, Metridia pacifica; identical to SEQ ID NO: 720

SEQ ID NO: 723 - DNA, 444 bp, Metridia pacifica; identical to SEQ ID NO: 719
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 724 - protein, 148 aa, Metridia pacifica; identical to SEQ ID NO: 720

SEQ ID NO: 725 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgycaygaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 726 - protein, 148 aa, Metridia longa
NTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCADCTTGCLKGLANVKCSDLLKKWLPDRCASFADKIQSEVHNIKGLAGDR

SEQ ID NO: 727 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 728 - protein, 148 aa, Metridia longa
NNDVNRGKMPGKKLPLEVLIEMEANAFKAGCTRGCLICLSKIKCTAKMKQYIPGRCHDYGGDKKTGQAGIVGAIVDIPEISGFKEMEPMEQFIAQVDRCADCTTGCLKGLANVKCSDLLKKWLPDRCASFADKIQKEAHNIKGLAGDR

SEQ ID NO: 729 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 730 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 731 - DNA, 444 bp, Metridia longa; identical to SEQ ID NO: 729
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 732 - protein, 148 aa, Metridia longa; identical to SEQ ID NO: 730

SEQ ID NO: 733 - DNA, 444 bp, Metridia longa; identical to SEQ ID NO: 729
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 734 - protein, 148 aa, Metridia longa; identical to SEQ ID NO: 730

SEQ ID NO: 735 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 736 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCADCTTGCLKGLANVKCSDLLKKWLPDRCASFADKIQKEVHNIKGMAGDR

SEQ ID NO: 737 - DNA, 444 bp, Metridia longa; identical to SEQ ID NO: 729
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 738 - protein, 148 aa, Metridia longa; identical to SEQ ID NO: 730

SEQ ID NO: 739 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 740 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCTTGCLKGLANVKCSDLLKKWLPDRCASFADKIQKEVHNIKGMAGDR

SEQ ID NO: 741 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 742 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCADCNTGCLKGLANVKCSDLLKKWLPDRCASFADKIQKEVHNIKGMAGDR

SEQ ID NO: 743 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgycaygaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 744 - protein, 148 aa, Metridia longa
ETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCADCTTGCLKGLANVKCSDLLKKWLPGRCASFADKIQKEVHNIKGMAGDR

SEQ ID NO: 745 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 746 - protein, 147 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 747 - DNA, 453 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (453)..(453): a, c, t, g, unknown or other
gayytngaygcngaymgnggnaarytnccnggnaaraarytnccnytngargtnytnaargaratggargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngayaargaygarytn

SEQ ID NO: 748 - protein, 151 aa, Gaussia princeps
DLDADRGKLPGKKLPLEVLKEMEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGDKDEL

SEQ ID NO: 749 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarathgargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnatggarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 750 - protein, 147 aa, Gaussia princeps
DLDADRGKLPGKKLPLEVLKEIEANARKAGCTRGCLICLSHIKCTPKMKKFIPGRCADYEGDKESAQGGIGEAIVDIPEIPGFKDLEPMEQFIAQVDRCADCTTGCLKGLANVKCSDLLKKWLPQRCATFASKIQGQVDKIKGAGGD

SEQ ID NO: 751 - DNA, 441 bp, Gaussia princeps
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
gayytngaygcngaymgnggnaarytnccnggnaaraarytnccnytngargtnytnaargarytngargcnaaygcnmgnaargcnggntgyacnmgnggntgyytnathtgyytnwsncayathaartgyacnccnaaratgaaraarttyathccnggnmgntgygcngaytaygarggngayaargarwsngcncarggnggnathggngargcnathgtngayathccngarathccnggnttyaargayytngarccnytngarcarttyathgcncargtngaymgntgygcngaytgyacnacnggntgyytnaarggnytngcnaaygtnaartgywsngayytnytnaaraartggytnccncarmgntgygcnacnttygcnwsnaarathcarggncargtngayaarathaarggngcnggnggngay

SEQ ID NO: 752 - protein, 147 aa, Gaussia princeps
DLDADRGKLPGKKLPLEVLKELEANARKAGCTRGCLICLSHIKCTPKMKKFIPGRCADYEGDKESAQGGIGEAIVDIPEIPGFKDLEPLEQFIAQVDRCADCTTGCLKGLANVKCSDLLKKWLPQRCATFASKIQGQVDKIKGAGGD

SEQ ID NO: 753 - DNA, 441 bp, Gaussia princeps; identical to SEQ ID NO: 745
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other

SEQ ID NO: 754 - protein, 147 aa, Gaussia princeps; identical to SEQ ID NO: 746

SEQ ID NO: 755 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnytngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 756 - protein, 151 aa, Metridia pacifica
DVDANRGGHGGHPGKKMPKEVLVEMEANAKRAGCHRGCLICLSHIKCTKKMKKFIPGRCADYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 757 - DNA, 453 bp, Metridia pacifica; identical to SEQ ID NO: 755
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other

SEQ ID NO: 758 - protein, 151 aa, Metridia pacifica; identical to SEQ ID NO: 756

SEQ ID NO: 759 - DNA, 453 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
gaygtngaygcnaaymgnggnggncayggnggncayccnggnaaraaratgccnaargargtnccngtngaratggargcnaaygcnaarmgngcnggntgycaymgnggntgyytnathtgyytnwsncayathaartgyacnaaraaratgaaraarttyathccnggnmgntgygcngaytaygarggngayaargaywsngcncarggnggnathggngargarathgtngayatgccngarathccnggnttyaargayaargarccnatggaycarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 760 - protein, 151 aa, Metridia pacifica
DVDANRGGHGGHPGKKMPKEVPVEMEANAKRAGCHRGCLICLSHIKCTKKMKKFIPGRCADYEGDKDSAQGGIGEEIVDMPEIPGFKDKEPMDQFIAQVDRCADCTTGCLKGLANVKCSDLLKKWLPSRCKTFASKIQSQVDTIKGLAGDR

SEQ ID NO: 761 - DNA, 456 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (39)..(39): a, c, t, g, unknown or other
  modified_base (42)..(42): a, c, t, g, unknown or other
  modified_base (54)..(54): a, c, t, g, unknown or other
  modified_base (63)..(63): a, c, t, g, unknown or other
  modified_base (66)..(66): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (144)..(144): a, c, t, g, unknown or other
  modified_base (147)..(147): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (258)..(258): a, c, t, g, unknown or other
  modified_base (276)..(276): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
gaygtngaygcnaaymgnggnggncayggnggncayccnggnaaraaratgccnaargargtnytnatggaratggargcnaaygcnaarmgngcnggntgycaymgnggntgyytngtntgyytnwsncayathaartgyacngcncaratgcaraarttyathccnggnmgntgygcngaytaygcnggngayaargaywsngcncarggnggnathgcnggnggngcnathgtngayathccngarathgcnggnttyaargaratgaarccnatggarcarttyathgcncargtngaymgntgygcngaytgyacnacnggntgyytnaarggnytngcnaaygtnaartgywsngayytnytnaaraartggytnccnwsnmgntgyaaracnttygcnwsnaarathcarwsncargtngayacnathaarggnytngcnggngaymgn

SEQ ID NO: 762 - protein, 152 aa, Metridia longa
DVDANRGGHGGHPGKKMPKEVLMEMEANAKRAGCHRGCLVCLSHIKCTAQMQKFIPGRCADYAGDKDSAQGGIAGGAIVDIPEIAGFKEMKPMEQFIAQVDRCADCTTGCLKGLANVKCSDLLKKWLPSRCKTFASKIQSQVDTIKGLAGDR

SEQ ID NO: 763 - DNA, 444 bp, Metridia pacifica
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aaywsngaygcngaymgnggnaaratgccnggnaaraarytnccnytngargtnytnathgaratggargcnaaygcnmgnaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargarytnggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtngayaayathaarggnytngcnggngaymgn

SEQ ID NO: 764 - protein, 148 aa, Metridia pacifica
NSDADRGKMPGKKLPLEVLIEMEANARKAGCTRGCLICLSKIKCTAKMKVYIPGRCADYGGDKKTGQAGIVGAIVDIPEISGFKELGPMEQFIAQVDRCADCTTGCLKGLANVKCSDLLKKWLPDRCASFADKIQSEVDNIKGLAGDR

SEQ ID NO: 765 - DNA, 444 bp, Metridia pacifica; identical to SEQ ID NO: 763
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 766 - protein, 148 aa, Metridia pacifica; identical to SEQ ID NO: 764

SEQ ID NO: 767 - DNA, 444 bp, Metridia pacifica; identical to SEQ ID NO: 763
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (81)..(81): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 768 - protein, 148 aa, Metridia pacifica; identical to SEQ ID NO: 764

SEQ ID NO: 769 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayacngaywsnaaymgnggnaaratgccnggnaaraarytnccnytngcngtnytnathgaratggargcnaaygcnttyaargcnggntgyacnmgnggntgyytnathtgyytnwsnaarathaartgyacngcnaaratgaaraartayathccnggnmgntgygcngaytayggnggngayaaraaracnggncargcnggnathgtnggngcnathgtngayathccngayathwsnggnttyaargaratgggnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcarwsngargtncayaayathaarggnytngcnggngaymgn

SEQ ID NO: 770 - protein, 148 aa, Metridia longa
NTDSNRGKMPGKKLPLAVLIEMEANAFKAGCTRGCLICLSKIKCTAKMKKYIPGRCADYGGDKKTGQAGIVGAIVDIPDISGFKEMGPMEQFIAQVDRCADCTTGCLKGLANVKCSDLLKKWLPDRCASFADKIQSEVHNIKGLAGDR

SEQ ID NO: 771 - DNA, 444 bp, Metridia longa
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
aayaaygaygtnaaymgnggnaaratgccnggnaaraarytnccnytngargtnytnathgaratggargcnaaygcnttyaargcnggntgyacnmgnggntgyytnathtgyytnwsnaarathaartgyacngcnaaratgaarcartayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargcncayaayathaarggnytngcnggngaymgn

SEQ ID NO: 772 - protein, 148 aa, Metridia longa
NNDVNRGKMPGKKLPLEVLIEMEANAFKAGCTRGCLICLSKIKCTAKMKQYIPGRCADYGGDKKTGQAGIVGAIVDIPEISGFKEMEPMEQFIAQVDRCADCTTGCLKGLANVKCSDLLKKWLPDRCASFADKIQKEAHNIKGLAGDR

SEQ ID NO: 773 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 774 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPDRCASFADKIQKEVHNIKGMAGDR

SEQ ID NO: 775 - DNA, 444 bp, Metridia longa; identical to SEQ ID NO: 773
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 776 - protein, 148 aa, Metridia longa; identical to SEQ ID NO: 774

SEQ ID NO: 777 - DNA, 444 bp, Metridia longa; identical to SEQ ID NO: 773
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 778 - protein, 148 aa, Metridia longa; identical to SEQ ID NO: 774

SEQ ID NO: 779 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngarmgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 780 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVERCADCTTGCLKGLANVKCSDLLKKWLPDRCASFADKIQKEVHNIKGMAGDR

SEQ ID NO: 781 - DNA, 444 bp, Metridia longa; identical to SEQ ID NO: 773
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other

SEQ ID NO: 782 - protein, 148 aa, Metridia longa; identical to SEQ ID NO: 774

SEQ ID NO: 783 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyacnacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 784 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCTTGCLKGLANVKCSDLLKKWLPDRCASFADKIQKEVHNIKGMAGDR

SEQ ID NO: 785 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggarccnatggarcarttyathgcncargtngaymgntgygcngaytgyaayacnggntgyytnaarggnytngcnaaygtnaartgywsngayytnytnaaraartggytnccngaymgntgygcnwsnttygcngayaarathcaraargargtncayaayathaarggnatggcnggngaymgn

SEQ ID NO: 786 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMEPMEQFIAQVDRCADCNTGCLKGLANVKCSDLLKKWLPDRCASFADKIQKEVHNIKGMAGDR

SEQ ID NO: 787 - DNA, 444 bp, Metridia longa
  modified_base (6)..(6): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (72)..(72): a, c, t, g, unknown or other
  modified_base (78)..(78): a, c, t, g, unknown or other
  modified_base (87)..(87): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (135)..(135): a, c, t, g, unknown or other
  modified_base (138)..(138): a, c, t, g, unknown or other
  modified_base (150)..(150): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (171)..(171): a, c, t, g, unknown or other
  modified_base (180)..(180): a, c, t, g, unknown or other
  modified_base (183)..(183): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (282)..(282): a, c, t, g, unknown or other
  modified_base (288)..(288): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (348)..(348): a, c, t, g, unknown or other
  modified_base (354)..(354): a, c, t, g, unknown or other
  modified_base (357)..(357): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
garacngaygcnaaymgnggnaaratgccnggnaaraarytnccnytngcngtnathatggaratggargcnaaygcnttyaargcnggntgyacnmgnggntgyytnathtgyytnwsnaarathaartgyacngcnaaratgaargtntayathccnggnmgntgygcngaytayggnggngayaaraaracnggncargcnggnathgtnggngcnathgtngayathccngarathwsnggnttyaargaratggcnccnatggarcarttyathgcncargtngaymgntgygcngaytgyacnacnggntgyytnaarggnytngcnaaygtnaartgywsngayytnytnaaraartggytnccnggnmgntgygcnwsnttygcngayaarathcaraargargtncayaayathaarggnatggcnggngaymgn

SEQ ID NO: 788 - protein, 148 aa, Metridia longa
ETDANRGKMPGKKLPLAVIMEMEANAFKAGCTRGCLICLSKIKCTAKMKVYIPGRCADYGGDKKTGQAGIVGAIVDIPEISGFKEMAPMEQFIAQVDRCADCTTGCLKGLANVKCSDLLKKWLPGRCASFADKIQKEVHNIKGMAGDR

SEQ ID NO: 789 - skipped

SEQ ID NO: 790 - protein, 189 aa, Metridia pacifica
MGVKLIFAVLCVAAAQAATINENFEDIDVVAIGGSFALDVDANRGGHGGHPGKKMPKEVLVEMEANAKRAGCHRGCLICLSHIKCTKKMKKFIPGRCHSYEGDKDSAQGGIGEEIVDMPEIPGFKDKEPMDQFIAQVDLCVDCTTGCLKGLANVHCSALLKKWLPSRCKTFASKIQSQVDTIKGLAGDR

SEQ ID NO: 791 - skipped

SEQ ID NO: 792 - protein, 210 aa, Metridia pacifica
MMEIQVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 793 - skipped

SEQ ID NO: 794 - protein, 210 aa, Metridia pacifica
MMEIKVLFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 795 - skipped

SEQ ID NO: 796 - protein, 210 aa, Metridia pacifica
MMEVKVVFALICFALVQANPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 797 - skipped

SEQ ID NO: 798 - protein, 169 aa, Metridia longa; identical to SEQ ID NO: 134

SEQ ID NO: 799 - skipped

SEQ ID NO: 800 - protein, 165 aa, Metridia longa
MKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 801 - skipped

SEQ ID NO: 802 - protein, 182 aa, Metridia longa
MDIKVVFTLVFSALVQAQKTDIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 803 - skipped

SEQ ID NO: 804 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCASCTTGCLKGLANVKCSELLKKWLPDRCASFADKIQKEVHNIKGMAGDR

SEQ ID NO: 805 - skipped

SEQ ID NO: 806 - protein, 219 aa, Metridia longa
MDIKVVFTLVFSALVQAKSTEFDPNIDIVGLEGKFGITNLETDLFTIWETMEVMIKADIADTDRASNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVERCASCTTGCLKGLANVKCSELLKKWLPDRCASFADKIQKEVHNIKGMAGDR

SEQ ID NO: 807 - skipped

SEQ ID NO: 808 - protein, 218 aa, Metridia longa
MDMKVIFALIFSALVQAKSTEFDPNIDIVGLEGKFGITNLETDLFTIWETMEVIKSDIADTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDRCTSCTTGCLKGLANVKCSELLKKWLPDRCASFADKIQKEVHNIKGMAGDR

SEQ ID NO: 809 - skipped

SEQ ID NO: 810 - protein, 218 aa, Metridia longa
MDIKVVFALVFSALVQAKSTEFDPNIDIVGLEGKFGITNLETDLFTIWETMEVIKTDIADTDRARSFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCTTGCLKGLANVKCSELLKKWLPDRCASFADKIQKEVHNIKGMAGDR

SEQ ID NO: 811 - skipped

SEQ ID NO: 812 - protein, 218 aa, Metridia longa
MDIKVVFALVFSALVQAKSTEFDPNIDVVGLEGKFGITNLETDLFTIWETMEVIKTDIADTDRARNFVATETDANRGKMPGKKLPLAVIMEMEANAFKAGCTRGCLICLSKIKCTAKMKVYIPGRCHDYGGDKKTGQAGIVGAIVDIPEISGFKEMEPMEQFIAQVDRCASCNTGCLKGLANVKCSELLKKWLPDRCASFADKIQKEVHNIKGMAGDR

SEQ ID NO: 813 - skipped

SEQ ID NO: 814 - protein, 218 aa, Metridia longa
MDMRVIFALVFSSLVQAKSTEFDPNINIVGLEGKFGITNLETDLFTIWETMDVIKSDITDTDRVSNFVATETDANRGKMPGKKLPLAVIMEMEANAFKAGCTRGCLICLSKIKCTAKMKVYIPGRCHDYGGDKKTGQAGIVGAIVDIPEISGFKEMAPMEQFIAQVDLCATCTTGCLKGLANVKCSELLKKWLPGRCASFADKIQKEVHNIKGMAGDR

SEQ ID NO: 815 - protein, 140 aa, Artificial Sequence
  Description of Artificial Sequence: Synthetic consensus polypeptide
  MOD_RES (6)..(6): Any hydrophobic amino acid
  MOD_RES (8)..(8): Any hydrophobic amino acid or basic amino acid
  MOD_RES (9)..(9): Any hydrophobic amino acid or acidic amino acid
  MOD_RES (11)..(11): Any hydrophobic amino acid or small amino acid
  MOD_RES (12)..(12): Any hydrophobic amino acid or basic amino acid
  MOD_RES (14)..(14): Any hydrophobic amino acid
  MOD_RES (19)..(19): Any basic amino acid or hydrophobic amino acid
  MOD_RES (20)..(20): Any basic amino acid
  MOD_RES (24)..(24): Any small amino acid or basic amino acid
  MOD_RES (29)..(29): Any hydrophobic amino acid
  MOD_RES (33)..(33): Any basic amino acid
  MOD_RES (38)..(38): Any small amino acid or basic amino acid
  MOD_RES (39)..(39): Any basic amino acid or neutral/polar amino acid
  MOD_RES (41)..(41): Any basic amino acid or neutral/polar amino acid
  MOD_RES (42)..(42): Any amino acid
  MOD_RES (43)..(43): Any hydrophobic amino acid
  MOD_RES (47)..(47): Any basic amino acid
  MOD_RES (49)..(49): Any basic amino acid or small amino acid
  MOD_RES (50)..(50): Any acidic amino acid or small amino acid
  MOD_RES (52)..(52): Any acidic amino acid or small amino acid
  MOD_RES (56)..(56): Any acidic amino acid or basic amino acid
  MOD_RES (57)..(57): Any small amino acid
  MOD_RES (58)..(58): Any small amino acid
  MOD_RES (60)..(60): Any small amino acid
  MOD_RES (63)..(63): Any small amino acid or hydrophobic amino acid
  MOD_RES (64)..(64): Any small amino acid or absent
  MOD_RES (65)..(65): Any acidic amino acid or small amino acid
  MOD_RES (66)..(66): Any small amino acid or acidic amino acid
  MOD_RES (70)..(70): Any hydrophobic amino acid
  MOD_RES (74)..(74): Any small amino acid
  MOD_RES (78)..(78): Any acidic amino acid
  MOD_RES (79)..(79): Any hydrophobic amino acid or basic amino acid
  MOD_RES (80)..(80): Any charged amino acid or small amino acid
  MOD_RES (82)..(82): Any hydrophobic amino acid
  MOD_RES (83)..(83): Any acidic amino acid
  MOD_RES (90)..(90): Any acidic amino acid
  MOD_RES (91)..(91): Any hydrophobic amino acid or basic amino acid
  MOD_RES (93)..(93): Any amino acid
  MOD_RES (94)..(94): Any acidic amino acid or small amino acid
  MOD_RES (96)..(96): Any small amino acid or neutral/polar amino acid
  MOD_RES (107)..(107): Any basic amino acid or neutral/polar amino acid
  MOD_RES (109)..(109): Any small amino acid
  MOD_RES (110)..(110): Any acidic amino acid or small amino acid
  MOD_RES (118)..(118): Any amino acid
  MOD_RES (119)..(119): Any basic amino acid
  MOD_RES (121)..(121): Any small amino acid or basic amino acid
  MOD_RES (122)..(122): Any small amino acid
  MOD_RES (125)..(125): Any acidic amino acid or small amino acid
  MOD_RES (129)..(129): Any small amino acid or basic amino acid
  MOD_RES (130)..(130): Any neutral/polar amino acid or acidic amino acid
  MOD_RES (131)..(131): Any hydrophobic amino acid or small amino acid
  MOD_RES (132)..(132): Any charged amino acid
  MOD_RES (133)..(133): Any amino acid
  MOD_RES (137)..(137): Any small amino acid or hydrophobic amino acid
  MOD_RES (138)..(138): Any small amino acid
  See specification as filed for detailed description of substitutions and preferred embodiments
LPGKKXPXXVXXEXEANAXXAGCXRGCLXCLSXIKCTXXMXXXIPGXCXXYXGDKXXXQXGIXXXXIVDXPEIXGFKXXXPXXQFIAQVXXCXXCXTGCLKGLANVXCXXLLKKWLPXXCXXFAXKIQXXXXXIKGXXGD

SEQ ID NO: 816 - protein, 4 aa, Gaussia princeps
KDEL

SEQ ID NO: 817 - protein, 4 aa, Artificial Sequence
  Description of Artificial Sequence: Synthetic peptide
RCAD

SEQ ID NO: 818 - protein, 4 aa, Artificial Sequence
  Description of Artificial Sequence: Synthetic peptide
KCAD

SEQ ID NO: 819 - protein, 4 aa, Artificial Sequence
  Description of Artificial Sequence: Synthetic peptide
RCED

SEQ ID NO: 820 - protein, 4 aa, Artificial Sequence
  Description of Artificial Sequence: Synthetic peptide
KCED

SEQ ID NO: 821 - protein, 4 aa, Artificial Sequence
  Description of Artificial Sequence: Synthetic peptide
RCSD

SEQ ID NO: 822 - protein, 4 aa, Artificial Sequence
  Description of Artificial Sequence: Synthetic peptide
KCSD

SEQ ID NO: 823 - protein, 4 aa, Artificial Sequence
  Description of Artificial Sequence: Synthetic peptide
RCTD

SEQ ID NO: 824 - protein, 4 aa, Artificial Sequence
  Description of Artificial Sequence: Synthetic peptide
KCTD

SEQ ID NO: 825 - protein, 4 aa, Artificial Sequence
  Description of Artificial Sequence: Synthetic peptide
RCAT

SEQ ID NO: 826 - protein, 4 aa, Artificial Sequence
  Description of Artificial Sequence: Synthetic peptide
RCAS

SEQ ID NO: 827 - protein, 4 aa, Artificial Sequence
  Description of Artificial Sequence: Synthetic peptide
KCAT

SEQ ID NO: 828 - protein, 4 aa, Artificial Sequence
  Description of Artificial Sequence: Synthetic peptide
KCAS

SEQ ID NO: 829 - protein, 5 aa, Artificial Sequence
  Description of Artificial Sequence: Synthetic peptide
  MOD_RES (2)..(2): Any basic amino acid
GXCAT

SEQ ID NO: 830 - protein, 160 aa, Artificial Sequence
  Description of Artificial Sequence: Synthetic consensus polypeptide
  MOD_RES (1)..(20): Any amino acid and this region may encompass 1 to 20 residues or may be absent
  MOD_RES (21)..(21): Any hydrophobic amino acid or basic amino acid
  MOD_RES (26)..(26): Any hydrophobic amino acid
  MOD_RES (28)..(28): Any hydrophobic amino acid or basic amino acid
  MOD_RES (29)..(29): Any hydrophobic amino acid or acidic amino acid
  MOD_RES (31)..(31): Any hydrophobic amino acid or small amino acid
  MOD_RES (32)..(32): Any hydrophobic amino acid or basic amino acid
  MOD_RES (34)..(34): Any hydrophobic amino acid
  MOD_RES (39)..(39): Any basic amino acid or hydrophobic amino acid
  MOD_RES (40)..(40): Any basic amino acid
  MOD_RES (44)..(44): Any small amino acid or basic amino acid
  MOD_RES (49)..(49): Any hydrophobic amino acid
  MOD_RES (53)..(53): Any basic amino acid
  MOD_RES (58)..(58): Any small amino acid or basic amino acid
  MOD_RES (59)..(59): Any basic amino acid or neutral/polar amino acid
  MOD_RES (61)..(61): Any basic amino acid or neutral/polar amino acid
  MOD_RES (62)..(62): Any amino acid
  MOD_RES (63)..(63): Any hydrophobic amino acid
  MOD_RES (67)..(67): Any basic amino acid
  MOD_RES (69)..(69): Any basic amino acid or small amino acid
  MOD_RES (70)..(70): Any acidic amino acid or small amino acid
  MOD_RES (72)..(72): Any acidic amino acid or small amino acid
  MOD_RES (76)..(76): Any acidic amino acid or basic amino acid
  MOD_RES (77)..(77): Any small amino acid
  MOD_RES (78)..(78): Any small amino acid
  MOD_RES (80)..(80): Any small amino acid
  MOD_RES (83)..(83): Any small amino acid or hydrophobic amino acid
  MOD_RES (84)..(84): Any small amino acid or absent
  MOD_RES (85)..(85): Any acidic amino acid or small amino acid
  MOD_RES (86)..(86): Any small amino acid or acidic amino acid
  MOD_RES (90)..(90): Any hydrophobic amino acid
  MOD_RES (94)..(94): Any small amino acid
  MOD_RES (98)..(98): Any acidic amino acid
  MOD_RES (99)..(99): Any hydrophobic amino acid or basic amino acid
  MOD_RES (100)..(100): Any charged amino acid or small amino acid
  MOD_RES (102)..(102): Any hydrophobic amino acid
  MOD_RES (103)..(103): Any acidic amino acid
  MOD_RES (110)..(110): Any acidic amino acid
  MOD_RES (111)..(111): Any hydrophobic amino acid or basic amino acid
  MOD_RES (113)..(113): Any amino acid
  MOD_RES (114)..(114): Any acidic amino acid or small amino acid
  MOD_RES (116)..(116): Any small amino acid or neutral/polar amino acid
  MOD_RES (127)..(127): Any basic amino acid or neutral/polar amino acid
  MOD_RES (129)..(129): Any small amino acid
  MOD_RES (130)..(130): Any acidic amino acid or small amino acid
  MOD_RES (138)..(138): Any amino acid
  MOD_RES (139)..(139): Any basic amino acid
  MOD_RES (141)..(141): Any small amino acid or basic amino acid
  MOD_RES (142)..(142): Any small amino acid
  MOD_RES (145)..(145): Any acidic amino acid or small amino acid
  MOD_RES (149)..(149): Any small amino acid or basic amino acid
  MOD_RES (150)..(150): Any neutral/polar amino acid or acidic amino acid
  MOD_RES (151)..(151): Any hydrophobic amino acid or small amino acid
  MOD_RES (152)..(152): Any charged amino acid
  MOD_RES (153)..(153): Any amino acid
  MOD_RES (157)..(157): Any small amino acid or hydrophobic amino acid
  MOD_RES (158)..(158): Any small amino acid
  See specification as filed for detailed description of substitutions and preferred embodiments
XXXXXXXXXXXXXXXXXXXXXPGKKXPXXVXXEXEANAXXAGCXRGCLXCLSXIKCTXXMXXXIPGXCXXYXGDKXXXQXGIXXXXIVDXPEIXGFKXXXPXXQFIAQVXXCXXCXTGCLKGLANVXCXXLLKKWLPXXCXXFAXKIQXXXXXIKGXXGD

SEQ ID NO: 831 - protein, 140 aa, Artificial Sequence
  Description of Artificial Sequence: Synthetic consensus polypeptide
  MOD_RES (1)..(1): Any hydrophobic amino acid or basic amino acid
  MOD_RES (6)..(6): Any hydrophobic amino acid
  MOD_RES (8)..(8): Any hydrophobic amino acid or basic amino acid
  MOD_RES (9)..(9): Any hydrophobic amino acid or acidic amino acid
  MOD_RES (11)..(11): Any hydrophobic amino acid or small amino acid
  MOD_RES (12)..(12): Any hydrophobic amino acid or basic amino acid
  MOD_RES (14)..(14): Any hydrophobic amino acid
  MOD_RES (19)..(19): Any basic amino acid or hydrophobic amino acid
  MOD_RES (20)..(20): Any basic amino acid
  MOD_RES (24)..(24): Any small amino acid or basic amino acid
  MOD_RES (29)..(29): Any hydrophobic amino acid
  MOD_RES (33)..(33): Any basic amino acid
  MOD_RES (38)..(38): Any small amino acid or basic amino acid
  MOD_RES (39)..(39): Any basic amino acid or neutral/polar amino acid
  MOD_RES (41)..(41): Any basic amino acid or neutral/polar amino acid
  MOD_RES (42)..(42): Any amino acid
  MOD_RES (43)..(43): Any hydrophobic amino acid
  MOD_RES (47)..(47): Any basic amino acid
  MOD_RES (49)..(49): Any basic amino acid or small amino acid
  MOD_RES (50)..(50): Any acidic amino acid or small amino acid
  MOD_RES (52)..(52): Any acidic amino acid or small amino acid
  MOD_RES (56)..(56): Any acidic amino acid or basic amino acid
  MOD_RES (57)..(57): Any small amino acid
  MOD_RES (58)..(58): Any small amino acid
  MOD_RES (60)..(60): Any small amino acid
  MOD_RES (63)..(63): Any small amino acid or hydrophobic amino acid
  MOD_RES (64)..(64): Any small amino acid or absent
  MOD_RES (65)..(65): Any acidic amino acid or small amino acid
  MOD_RES (66)..(66): Any small amino acid or acidic amino acid
  MOD_RES (70)..(70): Any hydrophobic amino acid
  MOD_RES (74)..(74): Any small amino acid
  MOD_RES (78)..(78): Any acidic amino acid
  MOD_RES (79)..(79): Any hydrophobic amino acid or basic amino acid
  MOD_RES (80)..(80): Any charged amino acid or small amino acid
  MOD_RES (82)..(82): Any hydrophobic amino acid
  MOD_RES (83)..(83): Any acidic amino acid
  MOD_RES (90)..(90): Any acidic amino acid
  MOD_RES (91)..(91): Any hydrophobic amino acid or basic amino acid
  MOD_RES (93)..(93): Any amino acid
  MOD_RES (94)..(94): Any acidic amino acid or small amino acid
  MOD_RES (96)..(96): Any small amino acid or neutral/polar amino acid
  MOD_RES (107)..(107): Any basic amino acid or neutral/polar amino acid
  MOD_RES (109)..(109): Any small amino acid
  MOD_RES (110)..(110): Any acidic amino acid or small amino acid
  MOD_RES (118)..(118): Any amino acid
  MOD_RES (119)..(119): Any basic amino acid
  MOD_RES (121)..(121): Any small amino acid or basic amino acid
  MOD_RES (122)..(122): Any small amino acid
  MOD_RES (125)..(125): Any acidic amino acid or small amino acid
  MOD_RES (129)..(129): Any small amino acid or basic amino acid
  MOD_RES (130)..(130): Any neutral/polar amino acid or acidic amino acid
  MOD_RES (131)..(131): Any hydrophobic amino acid or small amino acid
  MOD_RES (132)..(132): Any charged amino acid
  MOD_RES (133)..(133): Any amino acid
  MOD_RES (137)..(137): Any small amino acid or hydrophobic amino acid
  MOD_RES (138)..(138): Any small amino acid
  See specification as filed for detailed description of substitutions and preferred embodiments
XPGKKXPXXVXXEXEANAXXAGCXRGCLXCLSXIKCTXXMXXXIPGXCXXYXGDKXXXQXGIXXXXIVDXPEIXGFKXXXPXXQFIAQVXXCXXCXTGCLKGLANVXCXXLLKKWLPXXCXXFAXKIQXXXXXIKGXXGD

SEQ ID NO: 832 - protein, 5 aa, Artificial Sequence
  Description of Artificial Sequence: Synthetic peptide
  MOD_RES (1)..(1): Any amino acid other than Asp or Pro
  See specification as filed for detailed description of substitutions and preferred embodiments
XRCAS

SEQ ID NO: 833 - protein, 4 aa, Artificial Sequence
  Description of Artificial Sequence: Synthetic peptide
PGKK

SEQ ID NO: 834 - protein, 10 aa, Artificial Sequence
  Description of Artificial Sequence: Synthetic peptide
MGSDADRGKM

SEQ ID NO: 835 - protein, 10 aa, Artificial Sequence
  Description of Artificial Sequence: Synthetic peptide
MNSDADRGKM

SEQ ID NO: 836 - protein, 10 aa, Artificial Sequence
  Description of Artificial Sequence: Synthetic peptide
MNSDADRGKL

SEQ ID NO: 837 - protein, 9 aa, Artificial Sequence
  Description of Artificial Sequence: Synthetic peptide
NSDADRGKM

SEQ ID NO: 838 - protein, 12 aa, Artificial Sequence
  Description of Artificial Sequence: Synthetic peptide
DVDANRGGHGGH

SEQ ID NO: 839 - protein, 17 aa, Artificial Sequence
  Description of Artificial Sequence: Synthetic peptide
MDVDANRGGHGGHPGKK

SEQ ID NO: 840 - protein, 5 aa, Artificial Sequence
  Description of Artificial Sequence: Synthetic peptide
GHGGH

SEQ ID NO: 841 - protein, 14 aa, Artificial Sequence
  Description of Artificial Sequence: Synthetic peptide
MDVDANRGKLPGKK

SEQ ID NO: 842 - protein, 5 aa, Artificial Sequence
  Description of Artificial Sequence: Synthetic peptide
GHGGL

SEQ ID NO: 843 - protein, 4 aa, Artificial Sequence
  Description of Artificial Sequence: Synthetic peptide
LCVD

SEQ ID NO: 844 - protein, 4 aa, Artificial Sequence
  Description of Artificial Sequence: Synthetic peptide
LCAD

SEQ ID NO: 845 - protein, 4 aa, Artificial Sequence
  Description of Artificial Sequence: Synthetic peptide
RCTS

SEQ ID NO: 846 - protein, 4 aa, Artificial Sequence
  Description of Artificial Sequence: Synthetic peptide
LCAT

SEQ ID NO: 847 - protein, 4 aa, Artificial Sequence
  Description of Artificial Sequence: Synthetic peptide
LCED

SEQ ID NO: 848 - protein, 4 aa, Artificial Sequence
  Description of Artificial Sequence: Synthetic peptide
LCAS

SEQ ID NO: 849 - protein, 4 aa, Artificial Sequence
  Description of Artificial Sequence: Synthetic peptide
QCSD

SEQ ID NO: 850 - protein, 4 aa, Artificial Sequence
  Description of Artificial Sequence: Synthetic peptide
QCAD

SEQ ID NO: 851 - protein, 4 aa, Artificial Sequence
  Description of Artificial Sequence: Synthetic peptide
HCAD

SEQ ID NO: 852 - protein, 4 aa, Artificial Sequence
  Description of Artificial Sequence: Synthetic peptide
RCHD

SEQ ID NO: 853 - protein, 4 aa, Artificial Sequence
  Description of Artificial Sequence: Synthetic peptide
RCAE

SEQ ID NO: 854 - protein, 4 aa, Artificial Sequence
  Description of Artificial Sequence: Synthetic peptide
KCSA

SEQ ID NO: 855 - protein, 4 aa, Artificial Sequence
  Description of Artificial Sequence: Synthetic peptide
KCSE

SEQ ID NO: 856 - protein, 4 aa, Artificial Sequence
  Description of Artificial Sequence: Synthetic peptide
HCSD

SEQ ID NO: 857 - protein, 4 aa, Artificial Sequence
  Description of Artificial Sequence: Synthetic peptide
HCSA

SEQ ID NO: 858 - protein, 4 aa, Artificial Sequence
  Description of Artificial Sequence: Synthetic peptide
KCAE

SEQ ID NO: 859 - protein, 4 aa, Artificial Sequence
  Description of Artificial Sequence: Synthetic peptide
RCSE

SEQ ID NO: 860 - protein, 4 aa, Artificial Sequence
  Description of Artificial Sequence: Synthetic peptide
RCHT

SEQ ID NO: 861 - protein, 4 aa, Artificial Sequence
  Description of Artificial Sequence: Synthetic peptide
RCHS

SEQ ID NO: 862 - protein, 9 aa, Artificial Sequence
  Description of Artificial Sequence: Synthetic peptide
EAEAERGKL

SEQ ID NO: 863 - protein, 5 aa, Artificial Sequence
  Description of Artificial Sequence: Synthetic peptide
LPGKK

SEQ ID NO: 864 - protein, 4 aa, Artificial Sequence
  Description of Artificial Sequence: Synthetic peptide
ERGK

SEQ ID NO: 865 - protein, 8 aa, Artificial Sequence
  Description of Artificial Sequence: Synthetic peptide
AEAERGKL

SEQ ID NO: 866 - protein, 7 aa, Artificial Sequence
  Description of Artificial Sequence: Synthetic peptide
EAERKGL

SEQ ID NO: 867 - protein, 5 aa, Artificial Sequence
  Description of Artificial Sequence: Synthetic peptide
ERGKL

SEQ ID NO: 868 - protein, 9 aa, Artificial Sequence
  Description of Artificial Sequence: Synthetic peptide
EAEAERGKI

SEQ ID NO: 869 - protein, 9 aa, Artificial Sequence
  Description of Artificial Sequence: Synthetic peptide
EAEAERGKV

SEQ ID NO: 870 - protein, 9 aa, Artificial Sequence
  Description of Artificial Sequence: Synthetic peptide
EAEAERGGL

SEQ ID NO: 871 - protein, 7 aa, Artificial Sequence
  Description of Artificial Sequence: Synthetic peptide
EAEAGKL

SEQ ID NO: 872 - protein, 9 aa, Artificial Sequence
  Description of Artificial Sequence: Synthetic peptide
EAEAERGKA

SEQ ID NO: 873 - protein, 9 aa, Artificial Sequence
  Description of Artificial Sequence: Synthetic peptide
EAEAERGKF

SEQ ID NO: 874 - protein, 9 aa, Artificial Sequence
  Description of Artificial Sequence: Synthetic peptide
EAEAERGKH

SEQ ID NO: 875 - protein, 9 aa, Artificial Sequence
  Description of Artificial Sequence: Synthetic peptide
EAEAERGKP

SEQ ID NO: 876 - protein, 9 aa, Artificial Sequence
  Description of Artificial Sequence: Synthetic peptide
EAEAERGKT

SEQ ID NO: 877 - protein, 9 aa, Artificial Sequence
  Description of Artificial Sequence: Synthetic peptide
EAEAERGKY

SEQ ID NO: 878 - protein, 4 aa, Artificial Sequence
  Description of Artificial Sequence: Synthetic peptide
MGKL

SEQ ID NO: 879 - protein, 5 aa, Artificial Sequence
  Description of Artificial Sequence: Synthetic peptide
MRGKL

SEQ ID NO: 880 - protein, 6 aa, Artificial Sequence
  Description of Artificial Sequence: Synthetic peptide
MERGKL

SEQ ID NO: 881 - protein, 7 aa, Artificial Sequence
  Description of Artificial Sequence: Synthetic peptide
MGGHGGH

SEQ ID NO: 882 - protein, 7 aa, Artificial Sequence
  Description of Artificial Sequence: Synthetic peptide
MGGHGGL

SEQ ID NO: 883 - protein, 4 aa, Artificial Sequence
  Description of Artificial Sequence: Synthetic peptide
MGGL

SEQ ID NO: 884 - protein, 5 aa, Artificial Sequence
  Description of Artificial Sequence: Synthetic peptide
DRCAS

SEQ ID NO: 885 - protein, 5 aa, Artificial Sequence
  Description of Artificial Sequence: Synthetic peptide
QRCAT

SEQ ID NO: 886 - protein, 5 aa, Artificial Sequence
  Description of Artificial Sequence: Synthetic peptide
SRCKT

SEQ ID NO: 887 - protein, 5 aa, Artificial Sequence
  Description of Artificial Sequence: Synthetic peptide
GRCAS

SEQ ID NO: 888 - protein, 5 aa, Artificial Sequence
  Description of Artificial Sequence: Synthetic peptide
NRCAS

SEQ ID NO: 889 - protein, 5 aa, Artificial Sequence
  Description of Artificial Sequence: Synthetic peptide
SRCAS

SEQ ID NO: 890 - protein, 5 aa, Artificial Sequence
  Description of Artificial Sequence: Synthetic peptide
ARCAS

SEQ ID NO: 891 - protein, 5 aa, Artificial Sequence
  Description of Artificial Sequence: Synthetic peptide
TRCAS

SEQ ID NO: 892 - protein, 5 aa, Artificial Sequence
  Description of Artificial Sequence: Synthetic peptide
QRCAS

SEQ ID NO: 893 - protein, 5 aa, Artificial Sequence
  Description of Artificial Sequence: Synthetic peptide
GRCAT

SEQ ID NO: 894 - protein, 5 aa, Artificial Sequence
  Description of Artificial Sequence: Synthetic peptide
ERCAS

SEQ ID NO: 895 - protein, 5 aa, Artificial Sequence
  Description of Artificial Sequence: Synthetic peptide
HRCAS

SEQ ID NO: 896 - protein, 5 aa, Artificial Sequence
  Description of Artificial Sequence: Synthetic peptide
KRCAS

SEQ ID NO: 897 - protein, 5 aa, Artificial Sequence
  Description of Artificial Sequence: Synthetic peptide
PRCAS

SEQ ID NO: 898 - protein, 5 aa, Artificial Sequence
  Description of Artificial Sequence: Synthetic peptide
RRCAS

SEQ ID NO: 899 - protein, 5 aa, Artificial Sequence
  Description of Artificial Sequence: Synthetic peptide
TRCAT

SEQ ID NO: 900 - protein, 5 aa, Artificial Sequence
  Description of Artificial Sequence: Synthetic peptide
GRCKT

SEQ ID NO: 901 - protein, 10 aa, Artificial Sequence
  Description of Artificial Sequence: Synthetic peptide
MEAEAERGKL

SEQ ID NO: 902 - protein, 11 aa, Artificial Sequence
  Description of Artificial Sequence: Synthetic peptide
GSEAEAERGKL

SEQ ID NO: 903 - protein, 5 aa, Artificial Sequence
  Description of Artificial Sequence: Synthetic peptide
DRCAD

SEQ ID NO: 904 - protein, 5 aa, Artificial Sequence
  Description of Artificial Sequence: Synthetic peptide
ERCAD

SEQ ID NO: 905 - protein, 308 aa, Artificial Sequence
  Description of Artificial Sequence: Synthetic consensus polypeptide
  MOD_RES (1)..(84): Any amino acid and this region may encompass 1 to 84 residues or may be absent
  MOD_RES (85)..(85): Any amino acid
  MOD_RES (90)..(90): Any amino acid
  MOD_RES (92)..(93): Any amino acid
  MOD_RES (95)..(96): Any amino acid
  MOD_RES (98)..(98): Any amino acid
  MOD_RES (103)..(104): Any amino acid
  MOD_RES (108)..(108): Any amino acid
  MOD_RES (113)..(113): Any amino acid
  MOD_RES (117)..(117): Any amino acid
  MOD_RES (122)..(123): Any amino acid
  MOD_RES (125)..(127): Any amino acid
  MOD_RES (131)..(131): Any basic amino acid
  MOD_RES (133)..(134): Any amino acid
  MOD_RES (136)..(136): Any amino acid
  MOD_RES (140)..(142): Any amino acid
  MOD_RES (144)..(144): Any amino acid
  MOD_RES (147)..(150): Any amino acid
  MOD_RES (154)..(154): Any amino acid
  MOD_RES (158)..(158): Any amino acid
  MOD_RES (162)..(164): Any amino acid
  MOD_RES (166)..(167): Any amino acid
  MOD_RES (174)..(175): Any amino acid
  MOD_RES (177)..(178): Any amino acid
  MOD_RES (180)..(180): Any amino acid
  MOD_RES (191)..(191): Any amino acid
  MOD_RES (194)..(194): Any amino acid
  MOD_RES (202)..(202): Any amino acid
  MOD_RES (203)..(203): Any basic amino acid
  MOD_RES (205)..(206): Any amino acid
  MOD_RES (209)..(209): Any amino acid
  MOD_RES (213)..(217): Any amino acid
  MOD_RES (221)..(222): Any amino acid
  MOD_RES (225)..(308): Any amino acid and this region may encompass 1 to 84 residues or may be absent
  see specification as filed for detailed description of substitutions and preferred embodiments
XXXXXXXXXXXXXXXXXXXXXXXXXXXXXXXXXXXXXXXXXXXXXXXXXXXXXXXXXXXXXXXXXXXXXXXXXXXXXXXXXXXXXPGKKXPXXVXXEXEANAXXAGCXRGCLXCLSXIKCTXXMXXXIPGXCXXYXGDKXXXQXGIXXXXIVDXPEIXGFKXXXPXXQFIAQVXXCXXCXTGCLKGLANVXCSXLLKKWLPXXCXXFAXKIQXXXXXIKGXXGDXXXXXXXXXXXXXXXXXXXXXXXXXXXXXXXXXXXXXXXXXXXXXXXXXXXXXXXXXXXXXXXXXXXXXXXXXXXXXXXXXXXX

What is claimed is:

1. A method of modifying an isolated, synthetic, recombinant or purified copepod luciferase polypeptide comprising an amino acid sequence at least 80% identical to SEQ ID NO: 792 or SEQ ID NO: 2, the method comprising altering the copepod luciferase polypeptide such that it comprises a modification consisting of:

(a) at least one BC motif, wherein B is selected from basic amino acid residues and C is a conserved cysteine or modified form thereof; and the BC motif is selected from the group consisting of BCA at $C_5$, $C_6$, and/or $C_9$, BCAΩ at $C_5$, $C_6$, and/or $C_9$, and BCAD at $C_5$, $C_6$, and/or $C_9$, wherein Ω is selected from a small amino acid residue or an acidic amino acid residue, A is alanine or modified form thereof, D is aspartate or a modified form thereof, and $C_5$, $C_6$, and $C_9$ are conserved cysteines of consensus SEQ ID NO: 905;

and at least one of:

(i) L, or modified form thereof, at at least one position corresponding to positions 85 or 98 of consensus SEQ ID NO: 905; and (ii) a deletion in whole or in part of an amino acid sequence, wherein the amino acid sequence spans downstream of the signal peptide sequence and upstream of the amino acid residue at a position corresponding to position 85 of consensus SEQ ID NO: 905; or (b) at least one BC motif, wherein B is selected from basic amino acid residues and C is a conserved cysteine or modified form thereof; and the BC motif is selected from the group consisting of BCA at $C_5$ and/or $C_9$, BCAD at $C_5$, and/or $C_9$, and BCA at $C_5$and/or $C_9$, wherein Ω is selected from a small amino acid residue or an acidic amino acid residue, A is alanine or modified form thereof, D is aspartate or modified form thereof, and $C_5$, and $C_9$ are conserved cysteines of consensus SEQ ID NO: 905, and optionally, further comprising at least one of:

(i) L, or modified form thereof, at at least one position corresponding to positions 85 or 98 of consensus SEQ ID NO: 905; and (ii) a deletion in whole or in part of an amino acid sequence, wherein the amino acid sequence spans downstream of the signal peptide sequence and upstream of the amino acid residue at a position corresponding to position 85 of consensus SEQ ID NO: 905;

thereby producing a modified copepod luciferase polypeptide, wherein the modified polypeptide in (a) comprises at least one motif selected from the group consisting of:

(i) a BCA motif at at least one position corresponding to conserved cysteines $C_5$, $C_6$, and $C_9$; and (ii) a BCAΩ motif at at least one position corresponding to conserved cysteines $C_5$, $C_6$, and $C_9$; and a deletion in whole or in part of an amino acid sequence, wherein the amino acid sequence spans downstream of the signal peptide sequence and upstream of the amino acid residue at the position corresponding to position 85 of consensus SEQ ID NO: 905;

or in (b) comprises at least one motif selected from the group consisting of:

(i) a BCA motif at at least one position corresponding to conserved cysteines $C_5$ and $C_9$; and (ii) a BCAΩ motif at at least one position corresponding to conserved cysteines $C_5$ and $C_9$; and a deletion in whole or in part of an amino acid sequence, wherein the amino acid sequence spans downstream of the signal peptide sequence and upstream of the amino acid residue at the position corresponding to position 85 of consensus SEQ ID NO: 905.

2. The method according to claim 1, wherein the modified polypeptide comprises L, or modified form thereof, at the position corresponding to position 85 of consensus SEQ ID NO: 905.

3. The method according to claim 1, wherein the modified polypeptide comprises L, or modified form thereof, at the position corresponding to position 98 of consensus SEQ ID NO: 905.

4. The method according to claim 1, wherein the modified polypeptide comprises L, or modified form thereof, at the positions corresponding to positions 85 and 98 of consensus SEQ ID NO: 905.

5. The method according to claim 1, wherein the modified polypeptide in (a) comprises a BC motif at at least one position corresponding to conserved cysteines $C_6$ and $C_9$.

6. The method according to claim 1, wherein the modified polypeptide in (a) comprises a BCA motif at at least one position corresponding to conserved cysteines $C_5$, $C_6$ and $C_9$, or in (b) comprises a BCA motif at at least one position corresponding to conserved cysteines $C_5$ and $C_9$.

7. The method according to claim 1, wherein the modified polypeptide in (a) comprises a BCAΩ motif at at least one position corresponding to conserved cysteines $C_5$, $C_6$ and $C_9$, or in (b) comprises a BCAΩ motif at at least one position corresponding to conserved cysteines $C_5$ and $C_9$.

8. The method according to claim 1, wherein the modified polypeptide comprises:

(i) at least one amino acid selected from the group consisting of:

L or modified form thereof at the position corresponding to position 85 of consensus SEQ ID NO: 905;

L or modified form thereof at the position corresponding to position 98 of consensus SEQ ID NO: 905; and L or modified form thereof at the positions corresponding to positions 85 and 98 of consensus SEQ ID NO: 905, and (ii) at least one motif selected from the group consisting of:

a BCA motif at at least one position corresponding to conserved cysteines $C_5$, $C_6$, and $C_9$; and a BCAΩ motif at at least one position corresponding to conserved cysteines $C_5$, $C_6$, and $C_9$.

9. The method according to claim 1, wherein the modified polypeptide comprises:

(i) at least one amino acid selected from the group consisting of:

L or modified form thereof at the position corresponding to position 85 of consensus SEQ ID NO: 905;

L or modified form thereof at the position corresponding to position 98 of consensus SEQ ID NO: 905; and L or modified form thereof at the positions corresponding to positions 85 and 98 of consensus SEQ ID NO: 905;

(ii) at least one motif selected from the group consisting of:

a BCA motif at at least one position corresponding to conserved cysteines $C_5$, $C_6$, and $C_9$; and a BCAΩ motif at at least one position corresponding to conserved cysteines $C_5$, $C_6$, and $C_9$; and (iii) a deletion in whole or in part of an amino acid sequence of a reference copepod luciferase polypeptide, wherein the amino acid sequence spans downstream of the signal peptide sequence and upstream of the amino acid residue at the position corresponding to position 85 of consensus SEQ ID NO: 905.

10. A method of modifying an isolated, synthetic, recombinant or purified *Metridia* luciferase polypeptide comprising an amino acid sequence at least 80% identical to SEQ ID NO: 792, the method comprising altering the *Metridia* luciferase polypeptide such that it comprises modifications of:

(a) L, or modified form thereof, at at least one position corresponding to position 85 or 98 of consensus SEQ ID NO: 905; and (b) at least one BC motif, wherein B is selected from basic amino acid residues and C is a conserved cysteine or modified form thereof, and the BC motif is selected from the group consisting of BCA at $C_5$, $C_6$, and/or $C_9$, BCAD at $C_5$, $C_6$, and/or $C_9$, and BCAΩ at $C_5$, $C_6$, and/or $C_9$, wherein Ω is selected from a small amino acid residue or an acidic amino acid residue, A is alanine or modified form thereof, D is aspartate or modified form thereof, and $C_5$, $C_6$, and $C_9$ and are conserved cysteines of consensus SEQ ID NO: 905; and (c) optionally, a deletion in whole or in part of an amino acid sequence, wherein the amino acid sequence spans downstream of the signal peptide sequence and upstream of the amino acid residue at the position corresponding to position 85 of consensus SEQ ID NO: 905;

thereby producing a modified *Metridia* luciferase polypeptide.

11. A method of modifying an isolated, synthetic, recombinant or purified *Gaussia* luciferase polypeptide comprising an amino acid sequence at least 80% identical to SEQ ID NO: 2, the method comprising altering the *Gaussia* luciferase polypeptide such that it comprises modifications of:

(a) at least one BC motif, wherein B is selected from basic amino acid residues and C is a conserved cysteine, or modified form thereof; and the BC motif is selected from the group consisting of BCA at $C_5$, $C_6$, and/or $C_9$, BCAΩ at $C_5$, $C_6$, and/or $C_9$, and BCAD at $C_5$, $C_6$, and/or Cs, wherein Ω is selected from a small amino acid residue or an acidic amino acid residue, A is alanine or modified form thereof, D is aspartate or modified form thereof, and $C_5$, $C_6$, and $C_9$ are conserved cysteines of consensus SEQ ID NO: 905; and (b) a deletion in whole or in part of an amino acid sequence, wherein the amino acid sequence spans downstream of the signal peptide sequence and upstream of the amino acid residue at a position corresponding to position 85 of consensus SEQ ID NO: 905; and (c) optionally, L, or modified form thereof, at at least one position corresponding to position 85 or 98 of consensus SEQ ID NO: 905;

thereby producing a modified *Gaussia* luciferase polypeptide.

* * * * *

UNITED STATES PATENT AND TRADEMARK OFFICE

CERTIFICATE OF CORRECTION

PATENT NO. : 10,428,317 B2
APPLICATION NO. : 13/990250
DATED : October 1, 2019
INVENTOR(S) : John Daly, Leon Michael Brownrigg and Jim Yu-Hsiang Tiao It is certified that error appears in the above-identified patent and that said Letters Patent is hereby corrected as shown below:

In the Claims

Column 283, Line 47, Claim 1 reads:
"and/or C9, and BCA at C5 and/or C9, wherein Ω is selected"
Should read:
--and/or C9, and BCAΩ at C5 and/or C9, wherein Ω is selected--

Column 286, Line 31, Claim 11 reads:
"and/or Cs, wherein Ω is selected from a small amino"
Should read:
--and/or C9, wherein Ω is selected from a small amino--

Signed and Sealed this
Twenty-sixth Day of November, 2019

Andrei Iancu
*Director of the United States Patent and Trademark Office*